US008680050B2

(12) United States Patent  
Schellenberger et al.

(10) Patent No.: US 8,680,050 B2
(45) Date of Patent: *Mar. 25, 2014

(54) GROWTH HORMONE POLYPEPTIDES FUSED TO EXTENDED RECOMBINANT POLYPEPTIDES AND METHODS OF MAKING AND USING SAME

(75) Inventors: Volker Schellenberger, Palo Alto, CA (US); Joshua Silverman, Sunnyvale, CA (US); Willem P. Stemmer, Los Gatos, CA (US); Chia-Wei Wang, Milpitas, CA (US); Nathan Geething, Santa Clara, CA (US); Jeffrey L. Cleland, San Carlos, CA (US)

(73) Assignee: Amunix Operating Inc., Mountain View, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 12/848,984

(22) Filed: Aug. 2, 2010

(65) Prior Publication Data

US 2011/0172146 A1 Jul. 14, 2011

Related U.S. Application Data

(63) Continuation-in-part of application No. 12/796,640, filed on Jun. 8, 2010, which is a continuation-in-part of application No. 12/699,761, filed on Feb. 3, 2010.

(60) Provisional application No. 61/185,112, filed on Jun. 8, 2009, provisional application No. 61/236,836, filed on Aug. 25, 2009, provisional application No. 61/280,955, filed on Nov. 10, 2009, provisional application No. 61/149,669, filed on Feb. 3, 2009, provisional application No. 61/185,112, filed on Jun. 8, 2009, provisional application No. 61/268,193, filed on Jun. 8, 2009, provisional application No. 61/236,493, filed on Aug. 24, 2009, provisional application No. 61/236,836, filed on Aug. 25, 2009, provisional application No. 61/243,707, filed on Sep. 18, 2009, provisional application No. 61/245,490, filed on Sep. 24, 2009, provisional application No. 61/280,956, filed on Nov. 10, 2009, provisional application No. 61/281,109, filed on Nov. 12, 2009.

(51) Int. Cl.
*A61K 38/00* (2006.01)
*A61K 38/27* (2006.01)
*C12N 15/63* (2006.01)
*C07H 21/00* (2006.01)

(52) U.S. Cl.
USPC ........... 514/5.1; 514/4.7; 514/11.3; 435/69.1; 530/399; 536/23.4

(58) Field of Classification Search
None
See application file for complete search history.

(56) References Cited

U.S. PATENT DOCUMENTS

| | | |
|---|---|---|
| 5,089,473 A | 2/1992 | Krivi et al. |
| 5,141,922 A | 8/1992 | Krivi |
| 5,270,176 A | 12/1993 | Dorschug et al. |
| 5,399,489 A | 3/1995 | Krivi |
| 5,554,730 A | 9/1996 | Woiszwillo et al. |
| 5,599,907 A | 2/1997 | Anderson et al. |
| 6,500,448 B1 | 12/2002 | Johnson et al. |
| 6,692,941 B1 | 2/2004 | Miller et al. |
| 6,905,688 B2 | 6/2005 | Rosen et al. |
| 7,045,318 B2 | 5/2006 | Ballance |
| 7,442,778 B2 | 10/2008 | Gegg et al. |
| 7,452,967 B2 | 11/2008 | Bertin |
| 7,528,242 B2 | 5/2009 | Anderson et al. |
| 7,846,455 B2 | 12/2010 | Collins et al. |
| 2003/0049689 A1 | 3/2003 | Edwards et al. |
| 2003/0181381 A1 | 9/2003 | Himmelspach et al. |
| 2003/0190740 A1 | 10/2003 | Altman |
| 2004/0043446 A1 | 3/2004 | DeFrees et al. |
| 2004/0142870 A1 | 7/2004 | Finn |
| 2004/0259775 A1 | 12/2004 | Kyle |
| 2004/0259780 A1 | 12/2004 | Glasebrook et al. |
| 2005/0042721 A1 | 2/2005 | Fang et al. |
| 2005/0118136 A1 | 6/2005 | Leung et al. |
| 2005/0123997 A1 | 6/2005 | Lollar |
| 2005/0287153 A1 | 12/2005 | Dennis |
| 2006/0026719 A1 | 2/2006 | Kieliszewski et al. |
| 2006/0287220 A1 | 12/2006 | Li et al. |
| 2006/0293232 A1 | 12/2006 | Levy et al. |
| 2007/0048282 A1 | 3/2007 | Rosen et al. |
| 2007/0161087 A1 | 7/2007 | Glaesner et al. |
| 2007/0203058 A1 | 8/2007 | Lau et al. |
| 2007/0244301 A1 | 10/2007 | Siekmann et al. |
| 2008/0039341 A1 | 2/2008 | Schellenberger et al. |

(Continued)

FOREIGN PATENT DOCUMENTS

EP 0556171 B1 9/2000
RU 2005133665 A 6/2006

(Continued)

OTHER PUBLICATIONS

Etherton, et al. Biology of somatotropin in growth and lactation of domestic animals. Physiol Rev. Jul. 1998;78(3):745-61.
International search report dated Mar. 14, 2012 for PCT Application No. US2011/48517.
Alam, et al. Expression and purification of a mutant human growth hormone that is resistant to proteolytic cleavage by thrombin, plasmin and human plasma in vitro. J Biotechnol. 1998; 65(2-3):183-90.
Altschul et al. Basic Local Alignment Search Tool. J. Mol. Biol. 1990; 215:403-410.

(Continued)

*Primary Examiner* — Joanne Hama
*Assistant Examiner* — Ian Dang
(74) *Attorney, Agent, or Firm* — Wilson Sonsini Goodrich & Rosati

(57) ABSTRACT

The present invention relates to compositions comprising growth hormone linked to extended recombinant polypeptide (XTEN), isolated nucleic acids encoding the compositions and vectors and host cells containing the same, and methods of making and using such compositions in administration to animals.

26 Claims, 37 Drawing Sheets

(56) References Cited

U.S. PATENT DOCUMENTS

| | | |
|---|---|---|
| 2008/0167238 A1 | 7/2008 | Rosen et al. |
| 2008/0176288 A1 | 7/2008 | Leung et al. |
| 2008/0234193 A1 | 9/2008 | Bossard et al. |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0042787 A1 | 2/2009 | Metzner et al. |
| 2009/0060862 A1 | 3/2009 | Chang et al. |
| 2009/0092582 A1 | 4/2009 | Bogin et al. |
| 2010/0189682 A1 | 7/2010 | Schellenberger et al. |
| 2010/0239554 A1 | 9/2010 | Schellenberger et al. |
| 2011/0077199 A1 | 3/2011 | Schellenberger et al. |
| 2011/0151433 A1 | 6/2011 | Schellenberger et al. |

FOREIGN PATENT DOCUMENTS

| | | |
|---|---|---|
| WO | WO 97/11178 A1 | 3/1997 |
| WO | WO 97/33552 A1 | 9/1997 |
| WO | WO 9949901 A1 | 10/1999 |
| WO | WO 2005/025499 A2 | 3/2005 |
| WO | WO 2005/025499 A3 | 5/2005 |
| WO | WO 2006/024953 A2 | 3/2006 |
| WO | WO 2006/081249 A2 | 8/2006 |
| WO | WO 2006/081249 A3 | 2/2007 |
| WO | WO 2007/090584 A1 | 8/2007 |
| WO | WO 2007/103455 A2 | 9/2007 |
| WO | WO 2007/103455 A3 | 11/2007 |
| WO | WO 2008/077616 A1 | 7/2008 |
| WO | WO 2008/155134 A1 | 12/2008 |
| WO | WO 2010/091122 A1 | 8/2010 |

OTHER PUBLICATIONS

Alvarez, et al. Improving Protein Pharmacokinetics by Genetic Fusion to Simple Amino Acid Sequences. J Biol Chem. 2004; 279: 3375-81.

Arndt, et al. Factors influencing the dimer to monomer transition of an antibody single-chain Fv fragment. Biochemistry. 1998; 37(37):12918-26.

Ausubel, et al. eds. Current Protocols in Molecular Biology. Wiley. 1987.

Chou, et al. Prediction of Protein Conformation. Biochemistry. 1974; 13: 222-245.

Clark, et al. Long-acting growth hormones produced by conjugation with polyethylene glycol. J Biol Chem. 1996; 271(36):21969-77.

Clark, et al. Recombinant human growth hormone (GH)-binding protein enhances the growth-promoting activity of human GH in the rat. Endocrinology. 1996; 137(10):4308-15.

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

D'Aquino, et al. The magnitude of the backbone conformational entropy change in protein folding. Proteins. 1996; 25: 143-56.

Dattani, et al. An investigation into the lability of the bioactivity of human growth hormone using the ESTA bioassay. Horm Res. 1996; 46(2):64-73.

Deckert, et al. Pharmacokinetics and microdistribution of polyethylene glycol-modified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16: 504-17.

Ellis, et al. Valid and invalid implementations of GOR secondary structure predictions. Comput Appl Biosci. Jun. 1994;10(3):341-8. (Abstract only).

Greenwald, et al. Effective drug delivery by PEGylated drug conjugates. Adv Drug Deliv Rev. 2003; 55: 217-50.

Gustafsson, et al. Codon bias and heterologous protein expression. Trends Biotechnol. 2004; 22: 346-53.

Harris, et al. Effect of pegylation on pharmaceuticals. Nat Rev Drug Discov. 2003; 2: 214-21.

Hinds, et al. PEGylated insulin in PLGA microparticles. In vivo and in vitro analysis. J Control Release. Jun. 2, 2005;104(3):447-60.

Hopp, et al. Prediction of protein antigenic determinants from amino acid sequences. Proc Natl Acad Sci U S A 1981; 78, 3824, #3232.

International search report dated Oct. 29, 2010 for PCT Application No. US10/37855.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US10-23106.

Kochendoerfer. Chemical and biological properties of polymer-modified proteins. Expert Opin Biol. Ther. 2003; 3: 1253-61.

Kohn, et al. Random-coil behavior and the dimensions of chemically unfolded proteins. Proc Natl Acad Sci U S A. Aug. 24, 2004;101(34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Levitt. A simplified representation of protein conformations for rapid simulation of protein folding. J Mol Biol 1976; 104, 59-107.

McPherson, et al. eds. PCR 2: a practical approach. Oxford University Press. 1995.

Mitraki, et al. Protein Folding Intermediates and Inclusion Body Formation. Bio/Technology. 1989; 7:690-697.

Oslo, ed. Remington's Pharmaceutical Sciences. 16th edition. 1980.

Patra, et al. Optimization of inclusion body solubilization and renaturation of recombinant human growth hormone from *Escherichia coli*. Protein Expr Purif. 2000; 18(2):182-92.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Sambrook, et al. Molecular Cloning: A Laboratory Manual, 2nd Edition; Current Protocols in Molecular Biology. 1989.

Singh, et al. ProPred: Prediction of HLA-DR binding sites. Bioinformatics. 2001; 17: 1236-1237.

Smith, et al. Single-step purification of polypeptides expressed in *Escherichia coli* as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

Venkatachalam, et al. Conformation of polypeptide chains. Annu Rev Biochem. 1969; 38: 45-82.

Yang, et al. Tailoring structure-function and pharmacokinetic properties of single-chain Fv proteins by site-specific PEGylation. Protein Eng. 2003; 16: 761-70.

Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

European search report and search opinion dated Jan. 27, 2011 for Application No. 08795371.7.

Buscaglia, et al. Tandem amino acid repeats from *Trypanosoma cruzi* shed antigens increase the half-life of proteins in blood. Blood. Mar. 15, 1999;93(6):2025-32.

International search report dated Jul. 12, 2011 for PCT Application No. US20/61590.

Uversky, et al. Why are "natively unfolded" proteins unstructured under physiologic conditions? Proteins. Nov. 15, 2000;41(3):415-27.

Walker, et al. Using protein-based motifs to stabilize peptides. J Pept Res. Nov. 2003;62(5):214-26.

(56) References Cited

OTHER PUBLICATIONS

Wright, et al. Intrinsically unstructured proteins: re-assessing the protein structure-function paradigm. J Mol Biol. Oct. 22, 1999;293(2):321-31.

International search report and written opinion dated Dec. 20, 2010 for PCT Application No. US10/02147.

Schellenberger, et al. A recombinant polypeptide extends the in vivo half-life of peptides and proteins in a tunable manner. Nat Biotechnol. Dec. 2009;27(12):1186-92.

Cleland, et al. A novel human growth hormone XTEN construct (VRS-317) for monthly administration. Endocrine Journal, vol. 57, No. Suppl. 2, Mar. 2010, p. S618, XP002696184, & 14th International Congress of Endocrinology ICE2010; Kyoto, Japan; Mar. 26-30, 2010 ISSN: 0918-8959 (abstract).

Cleland, et al. A novel long-acting human growth hormone fusion protein (VRS-317): enhanced in vivo potency and half-life. J Pharm Sci. Aug. 2012;101(8):2744-54. doi: 10.1002/jps.23229. Epub Jun. 7, 2012.

European search report and search opinion dated May 14, 2013 for EP Application No. 10786725.

Kyngas, et al. Unreliability of the Chou-Fasman parameters in predicting protein secondary structure. Protein Eng. May 1998;11(5):345-8.

Office action dated Aug. 23, 2012 for U.S. Appl. No. 12/848,984.

Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.

A.
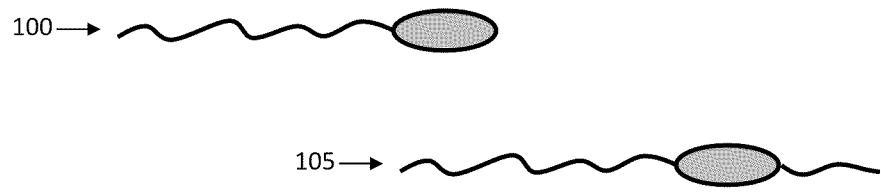
B.
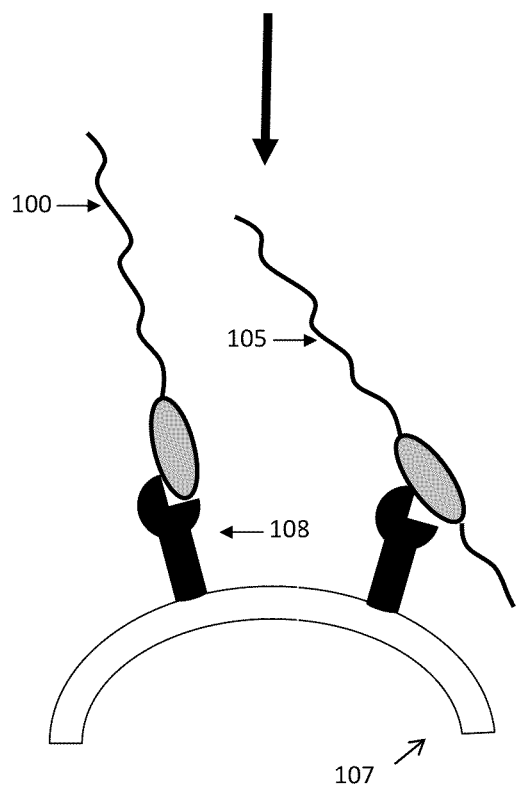
FIG. 3

```
LCW0569   ATGGCTNNNNNNGCTGGCTCTCCAACCTCCACTGAGGAAGGT
          M   A  X  X  A  G  S  P  T  S  T  E  E

LCW0570   ATGGCTNNNNNNGAAAGCGCAACCCCTGAGTCCGGTCCAGGT
          M   A  X  X  E  S  A  T  P  E  S  G  P

LCW0571   ATGGCTNNNNNNACTCCGTCTGGTGCTACCGGTTCCCCAGGT
          M   A  X  X  T  P  S  G  A  T  G  S  P
```

| X = APST, | GS | or | GE |
|---|---|---|---|
| TCAG/C/TCAG, | AG/G/TC | or | G/AG/AG |
| Diversity: 16 | 4 | | 4 |

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 10

A.
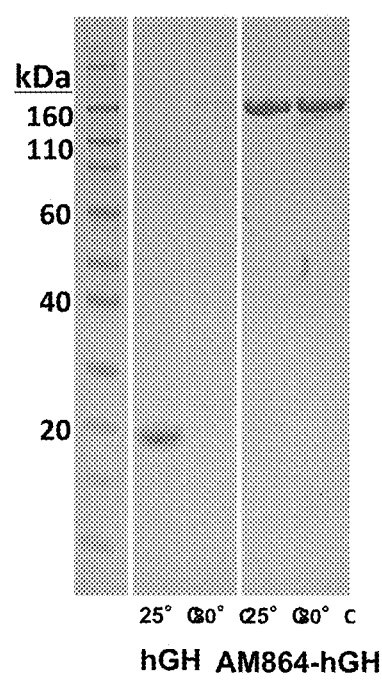
B.
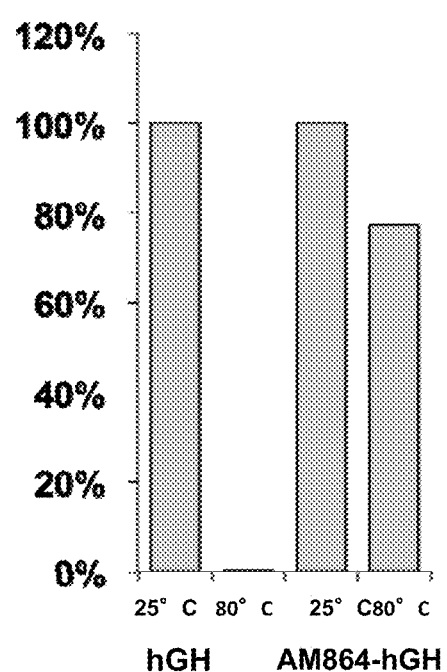
FIG. 17

A.
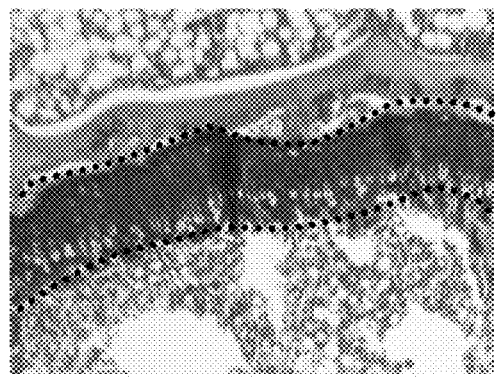
B.
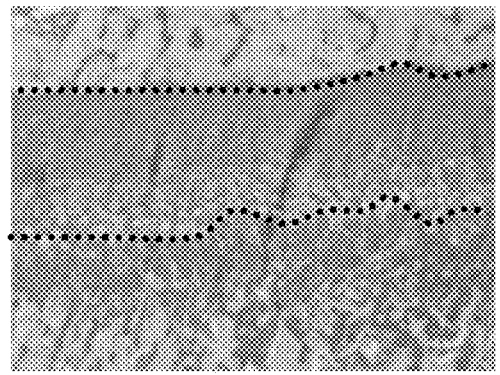
C.
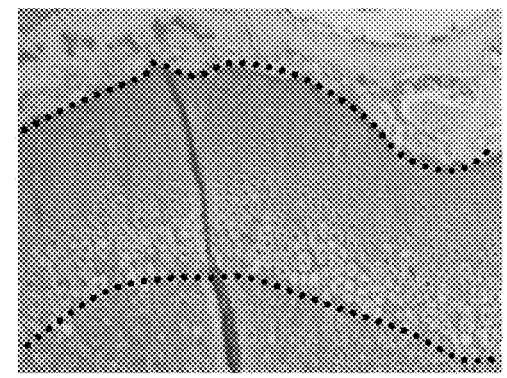
FIG. 26

GROWTH HORMONE POLYPEPTIDES FUSED TO EXTENDED RECOMBINANT POLYPEPTIDES AND METHODS OF MAKING AND USING SAME

CROSS-REFERENCE TO RELATED APPLICATIONS

This application is a continuation-in-part application of Ser. No. 12/796,640 filed on Jun. 8, 2010, which in turn claims priority benefit of U.S. Provisional Application Ser. Nos. 61/185,112 filed Jun. 8, 2009, 61/236,836 filed Aug. 25, 2009, and 61/280,955 filed Nov. 10, 2009, which is also a continuation-in-part application of Ser. No. 12/699,761, filed Feb. 3, 2010, which in turns claims the priority benefit of U.S. Provisional Application Ser. Nos. 61/149,669, filed Feb. 3, 2009, 61/185,112 filed Jun. 8, 2009, 61/268,193, filed Jun. 8, 2009, 61/236,493 filed Aug. 24, 2009, 61/236,836, filed Aug. 25, 2009. 61/243,707, filed Sep. 18, 2009, 61/245,490, filed Sep. 24, 2009, 61/280,955, filed Nov. 10, 2009, 61/280,956 filed Nov. 10, 2009, and 61/281,109, filed Nov. 12, 2009. This application is also a continuation-in-part application of Ser. No. 12/699,761, filed Feb. 3, 2010, which in turns claims the priority benefit of U.S. Provisional Application Ser. Nos. 61/149,669, filed Feb. 3, 2009, 61/185,112 filed Jun. 8, 2009, 61/268,193, filed Jun. 8, 2009, 61/236,493 filed Aug. 24, 2009, 61/236,836 filed Aug. 25, 2009, 61/243,707, filed Sep. 18, 2009, 61/245,490, filed Sep. 24, 2009, 61/280,955, filed Nov. 10, 2009, 61/280,956 filed Nov. 10, 2009, and 61/281,109 filed Nov. 12, 2009. All of the priority applications are incorporated herein by reference in their entirety for all purposes.

STATEMENT REGARDING FEDERALLY SPONSORED RESEARCH

This invention was made with government support under SBIR grant 2R44GM079873-02 awarded by the National Institutes of Health. The government has certain rights in the invention.

SEQUENCE LISTING

The instant application contains a Sequence Listing which has been submitted in ASCII format via EFS-Web and is hereby incorporated by reference in its entirety. Said ASCII copy, created on Mar. 14, 2011, is named 32808501.txt and is 1,620,622 bytes in size.

BACKGROUND OF THE INVENTION

Growth hormone (herein after "GH") is a hormone that participates in the regulation of mammalian growth and development. Growth hormone, also known as somatotrophin, represents a class of proteinaceous hormones produced and secreted by the somatotropic cells of the anterior pituitary. Secretion of GH is stimulated by the growth hormone releasing hormone (GHRH) from the hypothalamus and suppressed by somatostatin. This pituitary hormone exhibits a number of biological effects including somatogenesis, lactation, activation of macrophages, insulin-like and diabetogenic effects among others (Chawla, R, K. (1983) Ann. Rev. Med. 34, 519; Edwards, C. K. et al. (1988) Science 239, 769; Thorner, M. O., et al. (1988) J. Clin. Invest. 81, 745). Human growth hormone is a member of a family of homologous hormones that include placental lactogens, prolactins, and other genetic and species variants of GH. GH regulates the secretion of insulin-like growth factor (IGF-1, formerly known as somatomedin C), among other peptide hormones known collectively as somatomedins, which account for most of the biological activities.

Species-specific forms of GH have seen wide-spread use in domestic animals. For example, bovine growth hormone ("bGH"), also known as bovine somatotropin (abbreviated bST and BST), is a protein hormone produced in cattle. Recombinant forms of bGH have been utilized to increase the milk yield in lactating cows (Dohoo I R, Can J Vet Res. (2003) 67(4):241-251).

The growth velocity and body composition of humans, farm animals, and companion animals appear to respond to GH replacement therapies under a broad spectrum of conditions. GH directly stimulates division and multiplication of chondrocytes of cartilage, and GH also stimulates production of IGF-1 in canines (Prahalada S., et. al., Horm Metab Res. (1999) 31(2-3):133-137). IGF-1 has growth-stimulating effects on a wide variety of tissues. Additional IGF-1 is generated within target tissues, making it apparently both an endocrine and an autocrine/paracrine hormone. IGF-1 also has stimulatory effects on osteoblast and chondrocyte activity to promote bone growth.

Growth hormone (GH) plays a key role in somatic growth through its effects on the metabolism of proteins, carbohydrates and lipids. In addition to its effects on somatic growth, GH has been shown to stimulate blood cells in vitro (Derfalvi et al., 1998; Merchav et al; 1988), to increase erythrocytes and hemoglobin counts (Valerio et al., 1997; Vihervuori et al., 1996), to enhance both proliferation and Ig production in plasma cell lines (Kimata and Yoshida, 1994) and to stimulate $CD8^+$ cell counts and, to a lesser extent $CD4^+$ cell counts (Geffner, 1997).

A number of diseases and disorders are associated with the deficiency of GH. For example, as mammals age, the growth hormone releasing hormone-GH-insulin growth factor-1 (GHRH-GH-IGF-I) axis undergoes considerable decrement, with reduced GH secretion and IGF-I production, resulting in a loss of skeletal muscle mass (sarcopenia), osteoporosis, increased fat deposition, decreased lean body mass, and/or other disorders. Studies in humans and other mammals have demonstrated that the development of these changes can be offset by recombinant growth hormone ("GH") therapy.

The 22 kDA molecular weight of GH is well below the threshold value for kidney filtration of about 70 kDa (Caliceti (2003) Adv Drug Deliv Rev 55:1261-1277), which contributes to the serum half-life of native hGH being less than 20 minutes in humans. Thus, commercial preparations of GH must be dosed frequently to achieve benefit. A sustained-release form of human GH, Nutropin Depot (Genentech and Alkermes) was approved by the FDA in 1999, allowing for fewer injections (every 2 or 4 weeks instead of daily); however, the product was discontinued in 2004.

Chemical modifications to a therapeutic protein can reduce its in vivo clearance rate and increase subsequent serum half-life. One example of a common modification is the addition of a polyethylene glycol (PEG) moiety, typically coupled to the protein via an aldehyde or N-hydroxysuccinimide (NHS) group on the PEG reacting with an amine group (e.g. lysine side chain or the N-terminus). However, the conjugation step can result in the formation of heterogeneous product mixtures that need to be separated, leading to significant product loss and complexity of manufacturing and does not result in a completely chemically-uniform product. Also, the pharmacologic function of the therapeutic protein may be hampered if amino acid side chains in the vicinity of its binding site are modified by the PEGylation process. Fusing an Fc domain to the therapeutic protein is another approach to increase the size of the therapeutic protein, hence reducing the rate of clearance through the kidney. Additionally, the Fc domain confers the ability to bind to and be recycled from lysosomes by the FcRn receptor, which results in increased pharmacokinetic half-life. Unfortunately, the Fc domain does not fold efficiently during recombinant expression, and tends to form insoluble precipitates known as inclusion bodies. These inclusion bodies must be solubilized and functional protein must be renatured from the misfolded aggregates. Such process is time-consuming, inefficient, and expensive. Accordingly, there remains a need for improved growth hormone compositions with increased half-life which can be administered less frequently, and/or be produced by a simpler process at a cheaper cost.

SUMMARY OF THE INVENTION

The present invention is directed to compositions and methods for the treatment or improvement of a condition or the enhancement of a parameter associated with the administration of growth hormone. In particular, the present invention provides compositions of fusion proteins comprising one or more extended recombinant polypeptides (XTEN). A subject XTEN is typically a non-repetitive sequence having an unstructured conformation. In part, the present disclosure is directed to pharmaceutical compositions comprising the fusion proteins and the uses thereof for treating animals to achieve an improved or enhanced growth hormone-related condition or parameter.

In one embodiment, the invention provides an isolated fusion protein, comprising a growth hormone sequence that is at least about 90%, or about 95%, or about 96%, or about 97%, or about 98%, or about 99% identical to an amino acid sequence selected from Table 1. The growth hormone sequence has such sequence identity is further linked to an extended recombinant polypeptide (XTEN) of at least about 100, or at least about 200, or at least about 400, or at least about 800, or at least about 900, or at least about 1000, or at least about 2000, up to about 3000 amino acids residues. In one embodiment, the subject XTEN is characterized in that (a) the XTEN comprises at least about 200 contiguous amino acids that exhibits at least about 90%, or about 95%, or about 96%, or about 97%, or about 98%, or about 99% identical to a comparable length of an amino acid sequence selected from a sequence shown in Table 3; (b) the XTEN sequence lacks a predicted T-cell epitope when analyzed by TEPITOPE algorithm, wherein the TEPITOPE algorithm prediction for epitopes within the XTEN sequence is based on a score of −5, or −6, or −7, or −8, or −9 or greater; (c) the XTEN has a subsequence score of less than 10, or less than 9, or less than 8, or less than 7, or less than 6, or less than 5, or even less; and (d) the sum of glycine (G), alanine (A), serine (S), threonine (T), glutamate (E) and proline (P) residues constitutes more than about 90%, or about 95%, or about 96%, or about 97%, or about 98%, or about 99% of the total amino acid residues of the XTEN. In one embodiment, the growth hormone of the isolated fusion protein is a bovine growth hormone. In another embodiment, the isolated fusion protein comprises at least a second XTEN. The fusion protein can adopt a multiple-XTEN configuration shown in Table 5, or a variant thereof.

In another embodiment, the XTEN sequence of the GHXTEN fusion proteins is characterized in that is has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the present invention provides GHXTEN fusion proteins, wherein the XTEN is characterized in that the sum of asparagine and glutamine residues is less than 10% of the total amino acid sequence of the XTEN, the sum of methionine and tryptophan residues is less than 2% of the total amino acid sequence of the XTEN, the XTEN sequence has less than 5% amino acid residues with a positive charge, the XTEN sequence has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by the Chou-Fasman algorithm.

In another embodiment, the invention provides GHXTEN fusion proteins, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs consist of four to six types of amino acids selected from glycine (G), alanine (A), serine (S), threonine (T), glutamate (E) and proline (P).

In some embodiments, no one type of amino acid constitutes more than 30% of the XTEN sequence of the GHXTEN. In other embodiments, the XTEN has a sequence in which no three contiguous amino acids are identical unless the amino acid is serine, in which case no more than three contiguous amino acids are serine residues. In still other embodiments, at least about 80%, or about 90%, or about 95%, or about 96%, or about 97%, or about 98%, or about 99%, or 100% of the XTEN sequence consists of non-overlapping sequence motifs, wherein each of the sequence motifs has 12 amino acid residues. In one embodiment, the XTEN sequence consists of non-overlapping sequence motifs, wherein the sequence motifs are from one or more sequences of Table 2.

In some embodiments, GHXTEN fusion proteins exhibits enhanced pharmacokinetic properties compared to GH not linked to XTEN, wherein the enhanced properties include but are not limited to longer terminal half-life, larger area under the curve, increased time in which the blood concentration remains within the therapeutic window, increased time between consecutive doses, and decreased dose in moles over time. In some embodiments, the terminal half-life of the GHXTEN fusion protein administered to an animal is increased at least about two fold, or at least about three-fold, or at least about four-fold, or at least about five-fold, or at least about six-fold, or at least about eight-fold, or at least about ten-fold, or at least about 20-fold, or at least about 40-fold, or at least about 60-fold, or at least about 100-fold, or even higher as compared to GH not linked to XTEN and administered to an animal at a comparable dose. In other embodiments, the enhanced pharmacokinetic property is reflected by the fact that the blood concentrations that remain within the therapeutic window for the GHXTEN fusion protein for a given period are at least about two fold, or at least about three-fold, or at least about four-fold, or at least about five-fold, or at least about six-fold, or at least about eight-fold, or at least about ten-fold longer, or at least about 20-fold, or at least about 40-fold, or at least about 60-fold, or at least about 100-fold or more compared to GH not linked to XTEN and administered to an animal at a comparable dose. The increase in half-life and time spent within the therapeutic window permits less frequent dosing and decreased amounts of the fusion protein (in moles equivalent) that are administered to an animal, compared to the corresponding GH not linked to XTEN. In one embodiment, the physiologically effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold, or at least about 100-fold or more between at least two consecutive $C_{max}$ peaks and/or $C_{min}$ troughs for blood levels of the fusion protein, as compared to the corresponding GH not linked to the fusion protein and administered using a comparable dose regimen to an animal.

In some embodiments, the XTEN enhances thermostability of a biologically active protein when linked to the biologically active protein wherein the thermostability is ascertained by measuring the retention of biological activity after exposure to a temperature of about 37° C. for at least about 7 days of the biologically active protein in comparison to the XTEN linked to the biologically active protein. In one embodiment of the foregoing, the retention of biological activity increases by at least about 50%, at least about 60%, at least about 70%, at least about 80%, at least about 90%, at least about 100%, or about 150%, at least about 200%, at least about 300%, or about 500% or longer, as compared to the GH not linked to the XTEN.

In some embodiments, the isolated fusion protein with at least a first XTEN comprises a GH wherein the GH is a bovine growth hormone. In some embodiments, the isolated fusion protein further comprises a second XTEN, which can be identical or can be different from the first XTEN, and wherein the fusion protein adopts a multiple-XTEN configuration shown in Table 5. In one embodiment of the foregoing, the first and the second XTEN can each be a sequence selected from Table 3, or can exhibit at least at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from Table 3. In another embodiment, the isolated fusion protein comprising a second XTEN sequence adopts a multiple-XTEN configuration shown in Table 5.

In one embodiment, the isolated fusion protein is less immunogenic compared to the GH not linked to the XTEN, wherein immunogenicity is ascertained by, e.g., measuring production of IgG antibodies selectively binding to the biologically active protein after administration of comparable doses to an animal.

In some embodiments, the growth hormone peptide and the XTEN of the fusion protein is linked via a spacer, wherein the spacer sequence comprises between about 1 to about 50 amino acid residues that optionally comprises a cleavage sequence. In one embodiment, the cleavage sequence is susceptible to cleavage by a protease. Non-limiting examples of such protease include FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A.

In some embodiments, the isolated fusion protein is configured to have reduced binding affinity for a target receptor of the corresponding GH, as compared to the corresponding GH not linked to the fusion protein. In one embodiment, the GHXTEN fusion protein exhibits binding affinity for a target receptor of the GH in the range of about 0.01%-30%, or about 0.1% to about 20%, or about 1% to about 15%, or about 2% to about 10% of the binding affinity of the corresponding GH that lacks the XTEN. In another embodiment, the GHXTEN fusion protein exhibits binding affinity for a target receptor of the GH that is reduced at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold less binding affinity compared to GH not linked to XTEN. In a related embodiment, a fusion protein with reduced affinity can have reduced receptor-mediated clearance and a corresponding increase in half-life of at least about 3-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold, or at least about 30-fold, or at least about 50-fold, or at least about 100-fold longer compared to the corresponding GH that is not linked to the XTEN.

In one embodiment, the invention provides an isolated GHXTEN fusion protein comprising an amino acids sequence that has at least about 80%, or at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from Table 35, Table 36, and Table 37.

In some embodiments, the invention provides GHXTEN fusion proteins wherein the GHXTEN exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the GH not linked to the fusion protein.

In some embodiments, GHXTEN fusion proteins exhibit an increased apparent molecular weight as determined by size exclusion chromatography, compared to the actual molecular weight. For example, the apparent molecular weight is at least about 100 kD, or at least about 150 kD, or at least about 200 kD, or at least about 300 kD, or at least about 400 kD, or at least about 500 kD, or at least about 600 kD, or at least about 700 kD, while the actual molecular weight of each GH component of the fusion protein is less than about 25 kD. Accordingly, the GHXTEN fusion proteins can have an Apparent Molecular Weight that is about 4-fold greater, or about 5-fold greater, or about 6-fold greater, or about 7-fold greater, or about 8-fold greater than the actual molecular weight of the fusion protein. In some cases, the isolated GHXTEN fusion protein of the foregoing embodiments exhibits an apparent molecular weight factor under physiologic conditions that is greater than about 4, or about 5, or about 6, about 7, or about 8, or even higher.

The invention contemplates GHXTEN fusion proteins compositions comprising GH selected from Table 1 (or fragments or sequence variants thereof), XTEN selected from Table 3 (or sequence variants thereof) that are in a configuration selected from Table 5. Generally, the resulting GHXTEN will retain at least a portion of the biological activity of the corresponding GH not linked to the XTEN. In other cases, the GH component either becomes biologically active or has an increase in activity upon its release from the XTEN by cleavage of an optional cleavage sequence incorporated within spacer sequences into the GHXTEN.

In one embodiment of the GHXTEN composition, the invention provides a fusion protein of formula I:

$$(XTEN)_x\text{-}GH\text{-}(XTEN)_y \qquad I$$

wherein independently for each occurrence, GH is a growth hormone; x is either 0 or 1 and y is either 0 or 1 wherein x+y≥1; and XTEN is an extended recombinant polypeptide. In some embodiments, the XTEN is fused to the growth hormone on an N- or C-terminus of the growth hormone. In some embodiments, the isolated fusion protein of formula I comprises a bovine growth hormone and a first and a second XTEN selected from AE912, AM923, AE144, and AE288.

In another embodiment of the GHXTEN composition, the invention provides a fusion protein of formula II:

$$(XTEN)_x\text{-}(GH)\text{-}(S)_y\text{-}(XTEN)_y \qquad II$$

wherein independently for each occurrence, GH is a growth hormone; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment, the invention provides an isolated fusion protein, wherein the fusion protein is of formula III:

$$(GH)\text{-}(S)_x\text{-}(XTEN)\text{-}(S)_y\text{-}(GH)\text{-}(S)_z\text{-}(XTEN)_z \qquad III$$

wherein independently for each occurrence, GH is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

$$(XTEN)_x\text{-}(S)_y\text{-}(GH)\text{-}(S)_z\text{—}(XTEN)\text{-}(GH) \qquad IV$$

wherein independently for each occurrence, GH is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion growth hormone, wherein the fusion protein is of formula V:

$$(GH)_x\text{-}(S)_x\text{-}(GH)\text{-}(S)_y\text{—}(XTEN) \qquad V$$

wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VI:

$$(XTEN)\text{-}(S)_x\text{-}(GH)\text{-}(S)_y\text{-}(GH) \qquad VI$$

wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VII:

$$(XTEN)\text{-}(S)_x\text{-}(GH)\text{-}(S)_y\text{-}(GH)\text{-}(XTEN) \qquad VII$$

wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VIII:

$$((S)_m\text{-}(GH)_x\text{-}(S)_n\text{-}(XTEN)_y\text{-}(S)_o)_t \qquad VIII$$

wherein t is an integer that is greater than 0 (1, 2, 3, etc.); independently each of m, n, o, x, and y is an integer (0, 1, 2, 3, etc.), GH is a is a growth hormone; S is an spacer, optionally comprises a cleavage site; and XTEN is an extended recombinant polypeptide, with the proviso that: (1) x+y>1, (2) when t=1, x>0 and y>0, (3) when there is more than one GH, S, or XTEN, each GH, XTEN, or S are the same or are independently different; and (4) when t>1, each m, n, o, x, or y within each subunit are the same or are independently different.

In some embodiments, administration of a physiologically effective dose of a fusion protein of an embodiment of formulas I-VIII to an animal in need thereof can result in a gain in time of at least two-fold, or at least three-fold, or at least four-fold, or at least five-fold or more spent within a therapeutic window for the fusion protein compared to the corresponding GH not linked to the XTEN of and administered at a comparable dose to an animal. In other cases, administration of a physiologically effective dose of a fusion protein of an embodiment of formulas I-VIII to an animal in need thereof can result in a gain in time between consecutive doses necessary to maintain a physiologically effective dose regimen of at least 48 h, or at least 72 h, or at least about 96 h, or at least about 120 h, or at least about 7 days, or at least about 14 days, or at least about 21 days between consecutive doses compared to a GH not linked to XTEN and administered at a comparable dose.

The fusion proteins can be designed to have different configurations, N- to C-terminus, of a GH, XTEN, and optional spacer sequences, including but not limited to XTEN-GH, GH-XTEN, XTEN-S-GH, GH-S-XTEN, XTEN-GH-XTEN, GH-GH-XTEN, XTEN-GH-GH, GH-S-GH-XTEN, XTEN-GH-S-GH, and multimers thereof. The choice of configuration can, as disclosed herein, confer particular pharmacokinetic, physico/chemical, and/or pharmacologic properties.

In some embodiments, the isolated fusion protein is characterized in that: (i) it has a longer half-life compared to the corresponding growth hormone not linked to the XTEN; (ii) when a smaller molar amount of the fusion protein is administered to an animal in comparison to the corresponding growth hormone not lined to the XTEN administered to an animal under an otherwise equivalent dose regimen, the fusion protein achieves a comparable area under the curve (AUC) as the corresponding growth hormone not linked to the XTEN; (iii) when a smaller molar amount of the fusion protein is administered to an animal in comparison to the corresponding growth hormone not linked to the XTEN administered to an animal under an otherwise equivalent dose regimen, the fusion protein achieves a comparable therapeutic effect as the corresponding growth hormone not linked to the XTEN; (iv) when the fusion protein is administered to an animal less frequently in comparison to the corresponding growth hormone not linked to the XTEN administered to an animal using an otherwise equivalent molar amount, the fusion protein achieves a comparable area under the curve (AUC) as the corresponding growth hormone not linked to the XTEN; (v) when the fusion protein is administered to an animal less frequently in comparison to the corresponding growth hormone not linked to the XTEN administered to an animal using an otherwise equivalent molar amount, the fusion protein achieves a comparable therapeutic effect as the corresponding growth hormone not linked to the XTEN; (vi) when an accumulatively smaller molar amount of the fusion protein is administered to an animal in comparison to the corresponding growth hormone not linked to the XTEN administered to an animal under an otherwise equivalent dose period, the fusion protein achieves comparable area under the curve (AUC) as the corresponding growth hormone not linked to the XTEN; or (vii) when an accumulatively smaller molar amount of the fusion protein is administered to an animal in comparison to the corresponding growth hormone not linked to the XTEN administered to an animal under an otherwise equivalent dose period, the fusion protein achieves comparable therapeutic effect as the corresponding growth hormone not linked to the XTEN.

In one embodiment, the GHXTEN fusion proteins of formulas I-VIII described above exhibit a biological activity of at least about 0.1%, or at least about 0.1%, or at least about 1%, or at least about 2%, or at least about 3%, or at least about 4%, or at least about 5%, or at least about 10%, or at least about 20%, or at least about 30%, or at least 40%, or at least about 50%, or at least about 60%, or at least about 70%, or at least about 80%, or at least about 90%, or at least about 95% of the biological activity compared to the GH not linked to the XTEN. In another embodiment, the GHXTEN fusion proteins of formulas I-VIII bind the same receptors or ligands as the corresponding parental biologically active protein that is not covalently linked to the XTEN.

The invention provides a method of producing a fusion protein comprising a growth hormone fused to one or more extended recombinant polypeptides (XTEN), comprising: (a) providing host cell comprising a recombinant polynucleotide molecule encoding the fusion protein (b) culturing the host cell under conditions permitting the expression of the fusion protein; and (c) recovering the fusion protein. In one embodiment of the method, the growth hormone of the fusion protein has at least 90% sequence identity compared to a sequence selected from Table 1. In another embodiment of the method, the one or more XTEN of the expressed fusion protein has at least about 90%, or about 91%, or about 92%, or about 93%, or about 94%, or about 95%, or about 96%, or about 97%, or about 98%, or about 99% to about 100% sequence identity compared to a sequence selected from Table 3. In another embodiment of the method, the polynucleotide encoding the XTEN is codon optimized for enhanced expression of said fusion protein in the host cell. In another embodiment of the method, the host cell is a prokaryotic cell. In another embodiment of the method, the host cell is E. coli. In another embodiment of the method the isolated fusion protein is recovered from the host cell cytoplasm in substantially soluble form.

The invention provides isolated nucleic acids comprising a polynucleotide sequence selected from (a) a polynucleotide encoding the fusion protein of any of the foregoing embodiments, or (b) the complement of the polynucleotide of (a). In one embodiment, the invention provides an isolated nucleic acid comprising a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity compared to (a) a polynucleotide sequence of comparable length selected from Table 35, Table 36, and Table 37; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a prokaryotic signal sequence. In one embodiment, the secretion signal sequence is selected from OmpA, DsbA, and PhoA signal sequences.

The invention provides a host cell, which can comprise an expression vector disclosed in the foregoing paragraph. In one embodiment, the host cell is a prokaryotic cell. In another embodiment, the host cell is E. coli. In another embodiment, the host cell is a eukaryotic cell.

In one embodiment, the invention provides pharmaceutical compositions comprising the fusion protein of any of the foregoing embodiments and a pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to an animal.

The invention provides a method of treating an animal, comprising administering to the animal a physiologically-effective amount of the GHXTEN fusion protein of any of the foregoing embodiments, wherein said administration results in an increase or enhancement in at least one growth-hormone related parameter that is greater compared to a GH not linked to XTEN and administered to an animal at a comparable amount. In one embodiment of the method, the growth-hormone related parameter is selected from the group consisting of: IGF-1 levels, IGFBP3 levels, changes in growth velocity, lean body mass, total body fat, muscle mass, bone growth, lactation, duration of lactation, hoof growth, lipolysis, efficiency of converting feed to meat or milk, division and multiplication rates of chondrocytes, and changes in bone density. In one embodiment, the administration of the physiologically effective amount of the GHXTEN fusion protein results in at least about a 5%, or at least about a 6%, or at least about a 7%, or at least about a 8%, or at least about a 9%, or at least about a 10%, or more increase in the at least one parameter compared to the GH not linked to XTEN and administered to an animal at a comparable amount.

In some embodiments, the composition can be administered subcutaneously, intramuscularly, or intravenously. In one embodiment, the composition is administered at a physiologically effective amount, wherein the administered physiologically effective amount results in an increased terminal half-life gain for the fusion protein compared to the corresponding GH of the fusion protein not linked to the XTEN and administered at a comparable dose to an animal. The increase in terminal half-life can at least three-fold longer than the corresponding GH not linked to the XTEN, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer than the corresponding GH not linked to the XTEN. In some embodiments of the method of treatment, (i) a smaller molar amount of (e.g. of about two-fold less, or about three-fold less, or about four-fold less, or about five-fold less, or about six-fold less, or about eight-fold less, or about 100 fold-less or greater) the fusion protein is administered in comparison to the corresponding growth hormone not linked to the XTEN under an otherwise same dose regimen, and the fusion protein achieves a comparable area under the curve and/or a comparable therapeutic effect as the corresponding growth hormone not linked to the XTEN; (ii) the fusion protein is administered less frequently (e.g., every two days, about every seven days, about every 14 days, about every 21 days, or about, monthly) in comparison to the corresponding growth hormone not linked to the XTEN under an otherwise same dose amount, and the fusion protein achieves a comparable area under the curve and/or a comparable physiologic effect as the corresponding growth hormone not linked to the XTEN; or (iii) an accumulative smaller molar amount (e.g. about 5%, or about 10%, or about 20%, or about 40%, or about 50%, or about 60%, or about 70%, or about 80%, or about 90% less) of the fusion protein is administered in comparison to the corresponding growth hormone not linked to the XTEN under the otherwise same dose regimen the fusion protein achieves a comparable area under the curve and/or a comparable therapeutic effect as the corresponding growth hormone not linked to the XTEN. The accumulative smaller molar amount is measured for a period of at least about one week, or about 14 days, or about 21 days, or about one month. In some embodiments of the method, the physiologic effect is a measured parameter selected from IGF-1 levels, IGFBP3 levels, changes in growth velocity, lean body mass, total body fat, muscle mass, bone growth, lactation, duration of lactation, hoof growth, lipolysis, efficiency of converting feed to meat or milk, division and multiplication rates of chondrocytes, and changes in bone density.

In another embodiment, invention provides a method of treating an animal, comprising administering the pharmaceutical composition described above to an animal using multiple consecutive doses of the pharmaceutical composition administered using a physiologically effective dose regimen. In one embodiment of the foregoing, the physiologically effective dose regimen can result in a gain in time of at least three-fold, or alternatively, at least four-fold, or five-fold, or six-fold, or seven-fold, or eight-fold, or nine-fold, or at least 10-fold, or at least 20-fold, or at least about 30-fold, or at least about 50-fold, or at least about 100-fold longer time between at least two consecutive $C_{max}$ peaks and/or $C_{min}$ troughs for blood levels of the fusion protein compared to the corresponding GH of the fusion protein not linked to the XTENT and administered at a comparable dose regimen to an animal. In another embodiment of the foregoing, the administration of the fusion protein results in improvement in at least one measured parameter of a growth hormone-related condition or parameter using less frequent dosing or a lower total dosage in moles of the fusion protein of the pharmaceutical composition compared to the corresponding biologically active protein component(s) not linked to the fusion protein and administered to an animal using a physiologically effective regimen to an animal.

The invention further provides use of the compositions comprising the fusion protein of any of the foregoing embodiments in the preparation of a medicament for treating, improving, or increasing a condition in an animal. In one embodiment of the foregoing, the condition is IGF-1 and IGFBP3 concentrations, growth velocity, total body fat, muscle mass, bone growth, lactation, duration of lactation, hoof growth, lipolysis, and efficiency of converting feed to meat or milk, multiplication rates of chondrocytes, and bone density. Any of the disclosed embodiments can be practiced alone or in combination depending on the interested application.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1A shows two different configurations of GHXTEN fusion proteins (100), each comprising a single growth hormone (GH) and an XTEN, the first of which has an XTEN molecule (102) attached to the C-terminus of a GH (103), and the second of which has an XTEN molecule attached to the N-terminus of a GH (103). FIG. 1B shows two different configurations of GHXTEN fusion proteins (100), each comprising a single GH, a spacer sequence and an XTEN, the first of which has an XTEN molecule (102) attached to the C-terminus of a spacer sequence (104) and the spacer sequence attached to the C-terminus of a GH (103) and the second of which has an XTEN molecule attached to the N-terminus of a spacer sequence (104) and the spacer sequence attached to the N-terminus of a GH (103). FIG. 1C shows two different configurations of GHXTEN fusion proteins (101), each comprising two molecules of a single GH and one molecule of an XTEN, the first of which has an XTEN linked to the C-terminus of a first GH and that GH is linked to the C-terminus of a second GH, and the second of which is in the opposite orientation in which the XTEN is linked to the N-terminus of a first GH and that GH is linked to the N-terminus of a second GH. FIG. 1D shows two different configurations of GHXTEN fusion proteins (101), each comprising two molecules of a single GH, a spacer sequence and one molecule of an XTEN, the first of which has an XTEN linked to the C-terminus of a spacer sequence and the spacer sequence linked to the C-terminus of a first GH which is linked to the C-terminus of a second GH, and the second of which is in the opposite orientation in which the XTEN is linked to the N-terminus of a spacer sequence and the spacer sequence is linked to the N-terminus of a first GH that that GH is linked to the N-terminus of a second GH. FIG. 1E shows two different configurations of GHXTEN fusion proteins (101), each comprising two molecules of a single GH, a spacer sequence and one molecule of an XTEN, the first of which has an XTEN linked to the C-terminus of a first GH and the first GH linked to the C-terminus of a spacer sequence which is linked to the C-terminus of a second GH molecule, and the second of which is in the opposite configuration of XTEN linked to the N-terminus of a first GH which is linked to the N-terminus of a spacer sequence which in turn is linked to the N-terminus of a second molecule of GH. FIG. 1F shows a configuration of GHXTEN fusion protein (105), each comprising one molecule of GH and two molecules of an XTEN linked to the N-terminus and the C-terminus of the GH. FIG. 1G shows a configuration (106) of a single GH linked to two XTEN, with the second XTEN separated from the GH by a spacer sequence. FIG. 1H s a configuration (106) of a two GH linked to two XTEN, with the second XTEN linked to the C-terminus of the first GH and the N-terminus of the second GH, which is at the C-terminus of the GHXTEN.

FIG. 3A shows a GHXTEN fusion protein (100) consisting of a GH (103) and an XTEN (102) and a second GHXTEN fusion protein (105) consisting of a GH linked to two XTEN sequences (105). FIG. 3B shows the interaction of the GHXTEN with the GH on the C-terminus (100) and the GHXTEN with an XTEN on the C-terminus (105) with target receptors (108) to GH on a cell surface (107). In this case, binding to the receptor with high affinity is exhibited when GH has a free C-terminus, while the GHXTEN with a C-terminal XTEN does not bind as tightly to the receptor, and disassociates, as seen in FIG. 3C. FIG. 3D shows that the bound GHXTEN (100) with high binding affinity remains bound to the receptor (106) and has been internalized into an endosome (110) within the cell, illustrating receptor-mediated clearance of the bound GH and triggering cell signaling (109), portrayed as stippled cytoplasm.

FIG. 7A shows an exemplary expression vector encoding XTEN fused to the 3' end of the sequence encoding GH. Note that no additional leader sequences are required in this vector. FIG. 7B depicts an expression vector encoding XTEN fused to the 5' end of the sequence encoding GH with a CBD leader sequence and a TEV protease site. FIG. 7C depicts an expression vector as in FIG. 7B where the CBD and TEV processing sites have been replaced with an optimized N-terminal leader sequence (NTS). FIG. 7D depicts an expression vector encoding an NTS sequence, an XTEN, a sequence encoding GH, and than a second sequence encoding an XTEN.

FIG. 10 shows three randomized libraries used for the third and fourth codons in the N-terminal sequences of clones from LCW546, LCW547 and LCW552. The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of the three libraries LCW0569 (SEQ ID NOS 777-778, respectively, in order of appearance), LCW0570 (SEQ ID NOS 779-780, respectively, in order of appearance), and LCW0571 (SEQ ID NOS 781-782, respectively, in order of appearance).

FIGS. 17A-B shows the effects of heat treatment on stability of hGH and AM864-hGH, as described in Example 26. FIG. 17A is an SDS-PAGE gel of the two preparations treated at 25° C. and 80° C. for 15 minutes, while FIG. 17B shows the corresponding percentage of receptor binding activity of the 80° C. sample relative to the 25° C. treatment, indicating that the XTEN conferred heat stability and retention of activity to the hGH and the GHXTEN fusion protein.

FIG. 26 shows the comparative effects of administration of placebo, hGH, and AM864-hGH on growth of cartilage in the tibial epiphyseal plate in hypox rats, shown in histologic cross-sections of the tibia after 9 days of treatment, as described in Example 29.

FIG. 36A shows measured terminal half-life versus body mass, with a predicted T1/2 in humans of 139 h. FIG. 36B shows measured drug clearance versus body mass, with a predicted clearance rate value of 30 ml/h in humans. FIG. 36C shows measured volume of distribution versus body mass, with a predicted value of 5970 ml in humans.

DETAILED DESCRIPTION OF THE INVENTION

Figure 1:
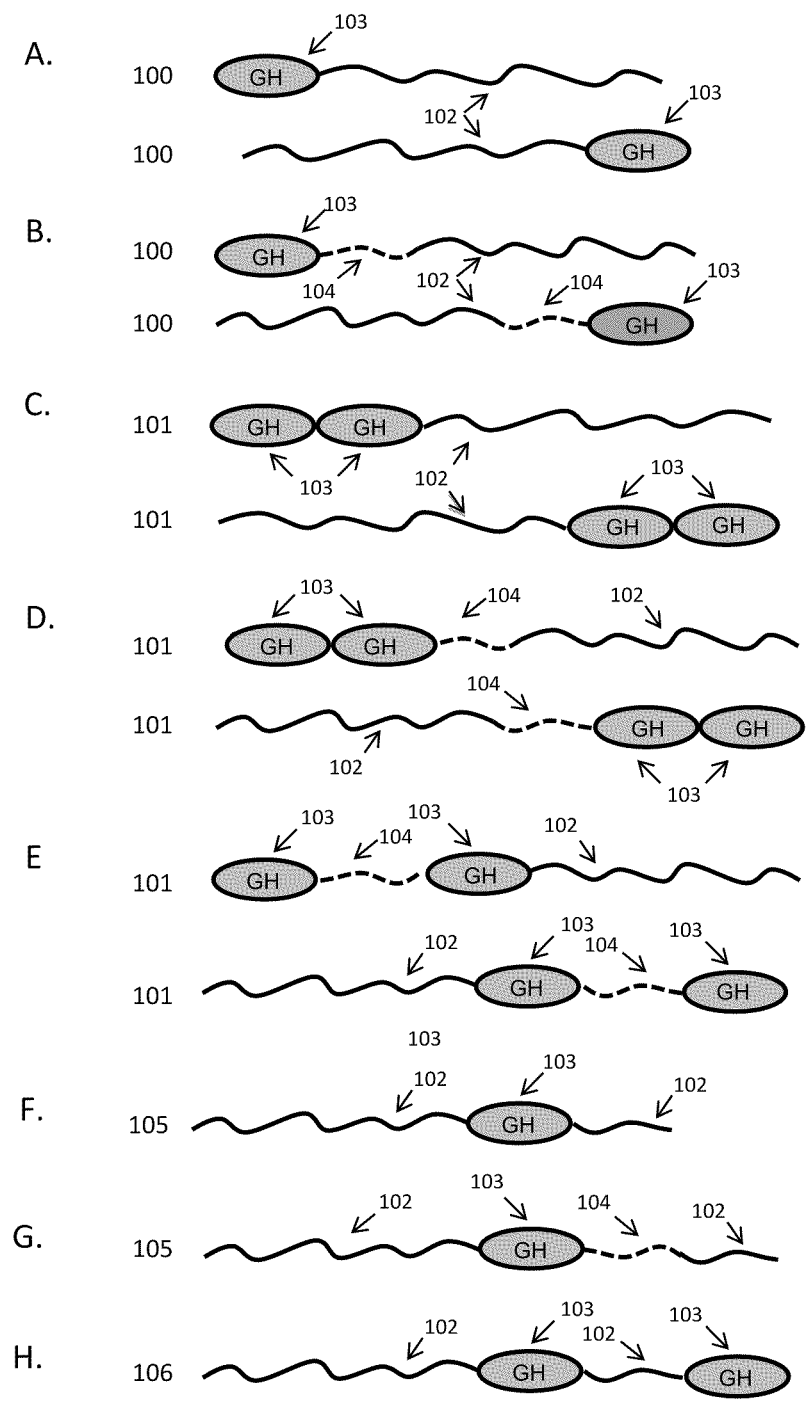
FIGS. 1A-H shows schematic representations of exemplary GHXTEN fusion proteins, all depicted in an N- to C-terminus orientation.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in an animal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity with the reference biologically active protein. As used herein, the term "biologically active protein moiety" includes proteins modified deliberately, as for example, by site directed mutagenesis, insertions, or accidentally through mutations.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

A "therapeutic effect" as applied to form(s) of a CFXTEN polypeptide provided herein, refers to a physiologic effect, including but not limited to the curing, mitigation, reversal, amelioration or prevention of disease or conditions in humans or other animals, or to otherwise enhance physical or mental wellbeing of humans or animals. A "physiologically effective amount" means an amount of compound effective to result in an increase, improvement, or enhancement of at least one growth hormone associated parameter of the animal being treated. Determination of a physiologically effective amount is well within the capability of those skilled in the art, especially in light of the detailed disclosure provided herein.

A "host cell" includes an individual cell or cell culture which can be or has been a recipient for the animal vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" or "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, $2^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 μg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide (s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Active clearance" means the mechanisms by which CF is removed from the circulation other than by filtration or coagulation, and which includes removal from the circulation mediated by cells, receptors, metabolism, or degradation of the CF.

"Apparent molecular weight factor" and "apparent molecular weight" are related terms referring to a measure of the relative increase or decrease in apparent molecular weight exhibited by a particular amino acid sequence. The apparent molecular weight is determined using size exclusion chromatography (SEC) and similar methods compared to globular protein standards and is measured in "apparent kD" units. The apparent molecular weight factor is the ratio between the apparent molecular weight and the actual molecular weight; the latter predicted by adding, based on amino acid composition, the calculated molecular weight of each type of amino acid in the composition or by estimation from comparison to molecular weight standards in an SDS electrophoresis gel.

The term "hydrodynamic radius" or "Stokes radius" is the effective radius ($R_h$, in nm) of a molecule in a solution measured by assuming that it is a body moving through the solution and resisted by the solution's viscosity. In the embodiments of the invention, the hydrodynamic radius measurements of the XTEN fusion proteins correlate with the 'apparent molecular weight factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294, 513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refers to a set of conditions in a living host as well as in vitro conditions, including temperature, salt concentration, pH, that mimic those conditions of a living animal. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" and "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" and "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker that may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the animal, notwithstanding that the animal may still be afflicted with the underlying disorder. For prophylactic benefit, the compositions may be administered to an animal at risk of developing a particular disease, or to an animal reporting one or more of the physiological symptoms of a disease, even though a diagnosis of this disease may not have been made.

A "physiologic effect", as used herein, refers to an effect, including but not limited to the cure, mitigation, amelioration, enhancement, or improvement of a physical or economic parameter or condition in an animal caused by administration of a growth hormone protein, either alone or as a part of a fusion protein composition, other than the ability to induce the production of an antibody against an antigenic epitope possessed by the biologically active protein. Determination of a physiologically effective amount is well within the capability of those skilled in the art, especially in light of the detailed disclosure provided herein.

The terms "physiologically effective amount" and "physiologically effective dose", as used herein, refer to an amount of a growth hormone protein, either alone or as a part of a fusion protein composition, that is capable of having any detectable, beneficial or enhanced effect on any symptom, aspect, measured parameter or characteristics when administered in one or repeated doses to an animal. Such effect need not be absolute to be beneficial.

The term "physiologically effective dose regimen", as used herein, refers to a schedule for consecutively administered multiple doses (i.e., at least two or more) of a biologically active protein, either alone or as a part of a fusion protein composition, wherein the doses are given in physiologically effective amounts to result in sustained beneficial effect on any symptom, aspect, measured parameter or characteristics in an animal.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," 3rd edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," 11th Edition, McGraw-Hill, 2005; and Freshney, R. I., "Culture of Animal Cells: A Manual of Basic Technique," 4th edition, John Wiley & Sons, Somerset, N.J., 2000, the contents of which are incorporated in their entirety herein by reference.

II). Growth Hormone

The present invention relates in part to fusion protein compositions of growth hormone (GH), including but not limited to growth hormones of domestic and wild animals.

(a) Growth Hormone Proteins

"Growth Hormone" or "GH" means a growth hormone protein and includes, but is not limited to, the amino acid sequences of Table 1 and sequence variants thereof. The GH can be the native, full-length protein or can be a truncated fragment or a sequence variant that retains at least a portion of the biological activity of the native protein. The invention contemplates use of the species-specific sequences, sequence variants and truncated fragments thereof as being appropriate for use as a fusion partner with XTEN disclosed herein for GHXTEN compositions. The cloned gene for hGH has been expressed in a secreted form in *Eschericha coli* (U.S. Pat. No. 4,898,830; Chang, C. N., et al., Gene 55:189 (1987)) and its DNA and amino acid sequence has been reported (Goeddel, et al. Nature, 281:544 [1979); Gray, et al., Gene 39: 247 (1985)), while bovine GH and sequence variants have been cloned and expressed in *E. coli* (U.S. Pat. Nos. 5,254,463, 5,089,473).

The invention contemplates inclusion in the GHXTEN compositions sequences with homology to GH sequences, sequence fragments that are natural, such as from animals (including domestic animals), and non-natural sequence variants which retain at least a portion of the biologic activity or biological function of GH and/or that are useful for effecting an outcome or an improvement or enhancement of a condition or physiologic or economic parameter. Non-mammalian GH sequences are well-described in the literature. For example, a sequence alignment of fish GHs can be found in *Genetics and Molecular Biology* 2003 26 p. 295-300. An analysis of the evolution of avian GH sequences is disclosed in *Journal of Evolutionary Biology* (2006) 19:844-854. In addition, native sequences homologous to human GH can be found by standard homology searching techniques, such as NCBI BLAST.

Effects of GH on the tissues of the body can generally be described as anabolic. Native GH acts by interacting with a specific plasma membrane receptor, referred to as growth hormone receptor. GH can act on the liver and other tissues to stimulate production of IGF-1, which is responsible for the growth promoting effects of GH and also governs the amount of GH produced. IGF-1, in turn, has stimulatory effects on osteoblast and chondrocyte activity to promote bone growth, amongst other physiological effects. In one embodiment, the invention provides a GHXTEN that exhibits at least one of the properties of native GH described herein.

In one embodiment, the GH incorporated into the animal compositions is a recombinant polypeptide with a sequence corresponding to a protein found in nature. In another embodiment, the GH is a sequence variant, fragment, homolog, or a mimetics of a natural sequence that retains at least a portion of the biological activity of the corresponding native GH. Table 1 provides a non-limiting list of sequences of GHs from a wide variety of animal species that are encompassed by the GHXTEN fusion proteins of the invention. Any of these GH sequences or homologous derivatives constructed by shuffling individual mutations between species or families that retain at least a portion of the biological activity of the native GH can be useful for the fusion proteins of this invention. GH that can be incorporated into a GHXTEN fusion protein can include a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence from Table 1.

TABLE 1

Growth hormone amino acid sequences from animal species

| Species GH | SEQ ID NO: | Amino Acid Sequence |
|---|---|---|
| Human | 1 | FPTIPLSRLFDNAMLRAHRLHQLAFDTYQEFEEAYIPKEQKYSFLQNP<br>QTSLCFSESIPTPSNREETQQKSNLELLRISLLLIQSWLEPVQFLRSVFA<br>NSLVYGASDSNVYDLLKDLEEGIQTLMGRLEDGSPRTGQIFKQTYSKF<br>DTNSHNDDALLKNYGLLYCFRKDMDKVETFLRIVQCRSVEGSCGF |
| Pig | 2 | FPAMPLSSLFANAVLRAQHLHQLAADTYKEFERAYIPEGQRYSIQNA<br>QAAFCFSETIPAPTGKDEAQQRSDVELLRFSLLLIQSWLGPVQFLSRVF<br>TNSLVFGTSDRVYEKLKDLEEGIQALMRELEDGSPRAGQILKQTYDK<br>FDTNLRSDDALLKNYGLLSCFKKDLHKAETYLRV<br>MKCRRFVESSCAF |
| Alpaca | 3 | FPAMPLSSLFANAVLRAQHLHQLAADTYKEFERTYIPEGQRYSIQNAQ<br>AAFCFSETIPAPTGKDEAQQRSDVELLRFSLLLIQSWLGPVQFLSRVFT<br>NSLVFGTSDRVYEKLKDLEEGIQALMRELEDGSPRAGQILRQTYDKF<br>DTNLRSDDALLKNYGLLSCFKKDLHKAETYLRV MKCRRFVESSCAF |
| Camel | 4 | FPAMPLSSLFANAVLRAQHLHQLAADTYKEFERTYIPEGQRYSIQNAQ<br>AAFCFSETIPAPTGKDEAQQRSDVELLRFSLLLIQSWLGPVQFLSRVFT |

TABLE 1-continued

Growth hormone amino acid sequences from animal species

| Species GH | SEQ ID NO: | Amino Acid Sequence |
|---|---|---|
| | | NSLVFGTSDRVYEKLKDLEEGIQALMRELEDGSPRAGQILRQTYDKF DTNLRSDDALLKNYGLLSCFKKDLHKAETYLRV MKCRRFVESSCAF |
| Horse | 5 | FPAMPLSSLFANAVLRAQHLHQLAADTYKEFERAYIPEGQRYSIQNA QAAFCFSETIPAPTGKDEAQQRSDMELLRFSLLLIQSWLGPVQLLSRV FTNSLVFGTSDRVYEKLRDLEEGIQALMRELEDGSPRAGQILKQTYDK FDTNLRSDDALLKNYGLLSCFKKDLHKAETYLRV MKCRRFVESSCAF |
| Elephant | 6 | FPAMPLSSLFANAVLRAQHLHQLAADTYKEFERAYIPEGQRYSIQNA QAAFCFSETIPAPTGKDEAQQRSDVELLRFSLLLIQSWLGPVQFLSRVF TNSLVFGTSDRVYEKLKDLEEGIQALMRELEDGSPRPGQVLKQTYDK FDTNMRSDDALLKNYGLLSCFKKDLHKAETYLRV MKCRRFVESSCAF |
| Red fox | 7 | FPAMPLSSLFANAVLRAQHLHQLAADTYKEFERAYIPEGQRYSIQNA QAAFCFSETIPAPTGKDEAQQRSDVELLRFSLVLIQSWLGPLQFLSRVF TNSLVFGTSDRVYEKLKDLEEGIQALMRELEDGSPRAGQILKQTYDK FDTNLRSDDALLKNYGLLSCFKKDLHKAETYLRV MKCRRFVESSCAF |
| Dog | 8 | FPAMPLSSLFANAVLRAQHLHQLAADTYKEFERAYIPEGQRYSIQNA QAAFCFSETIPAPTGKDEAQQRSDVELLRFSLLLIQSWLGPVQFLSRVF TNSLVFGTSDRVYEKLKDLEEGIQALMRELEDGSPRAGQILKQTYDK FDTNLRSDDALLKNYGLLSCFKKDLHKAETYLRV MKCRRFVESSCAF |
| Cat | 9 | FPAMPLSSLFANAVLRAQHLHQLAADTYKEFERAYIPEGQRYSIQNA QAAFCFSETIPAPTGKDEAQQRSDVELLRFSLLLIQSWLGPVQFLSRVF TNSLVFGTSDRVYEKLKDLEEGIQALMRELEDGSPRGGQILKQTYDK FDTNLRSDDALLKNYGLLSCFKKDLHKAETYLRV MKCRRFVESSCAF |
| American mink | 10 | FPAMPLSSLFANAVLRAQHLHQLAADTYKDFERAYIPEGQRYSIQNA QAAFCFSETIPAPTGKDEAQQRSDMELLRFSLLLIQSWLGPVQFLSRVF TNSLVFGTSDRVYEKLKDLEEGIQALMRELEDGSPRAGPILKQTYDKF DTNLRSDDALLKNYGLLSCFKKDLHKAETYLRV MKCRRFVESSCAF |
| Finback whale | 11 | FPAMPLSSLFANAVLRAQHLHQLAADTYKEFERAYIPEGQRYSIQNA QAAFCFSETIPAPTGKDEAQQRSDVELLRFSLLLIQSWLGPVQFLSRVF TNSLVFGTSDRVYEKLKDLEEGIQALMRELEDGSPRAGQILKQTYDK FDTNMRSDDALLKNYGLLSCFKKDLHKAETYLRV MKCRRFVESSCAF |
| Dolphin | 12 | FPAMPLSSLFANAVLRAQHLHQLAADTYKEFERAYIPEGQRYSIQNTQ AAFCFSETIPAPTGKDEAQQRSDVELLRFSLLLIQSWLGPVQFLSRVFT NSLVFGTSDRVYEKLKDLEEGIQALMRELEDGSPRAGQILKQTYDKF DTNMRSDDALLKNYGLLSCFKKDLHKAETYLRV MKCRRFVESSCAF |
| Hippo | 13 | FPAMPLSSLFANAVLRAQHLHQLAADTYKEFERAYIPEGQRYSIQNTQ AAFCFSETIPAPTGKDEAQQRSDVELLRFSLLLIQSWLGPVQFLSRVFT NSLVFGTSDRVYEKLKDLEEGIQALMRELEDGSPRAGQILKQTYDKF DTNMRSDDALLKNYGLLSCFKKDLHKAETYLRV MKCRRFVESSCAF |
| Rabbit | 14 | FPAMPLSSLFANAVLRAQHLHQLAADTYKEFERAYIPEGQRYSIQNA QAAFCFSETIPAPTGKDEAQQRSDMELLRFSLLLIQSWLGPVQFLSRAF TNTLVFGTSDRVYEKLKDLEEGIQALMRELEDGSPRVGQLLKQTYDK FDTNLRGDDALLKNYGLLSCFKKDLHKAETYLRV MKCRRFVESSCVF |
| Rat | 15 | FPAMPLSSLFANAVLRAQHLHQLAADTYKEFERAYIPEGQRYSIQNA QAAFCFSETIPAPTGKEEAQQRTDMELLRFSLLLIQSWLGPVQFLSRIF TNSLMFGTSDRVYEKLKDLEEGIQALMQELEDGSPRIGQILKQTYDKF DANMRSDDALLKNYGLLSCFKKDLHKAETYLRV MKCRRFAESSCAF |
| Mouse | 16 | FPAMPLSSLFSNAVLRAQHLHQLAADTYKEFERAYIPEGQRYSIQNAQ AAFCFSETIPAPTGKEEAQQRTDMELLRFSLLLIQSWLGPVQFLSRIFT NSLMFGTSDRVYEKLKDLEEGIQALMQELEDGSPRVGQILKQTYDKF DANMRSDDALLKNYGLLSCFKKDLHKAETYLRV MKCRRFVESSCAF |
| Hamster | 17 | FPAMPLSSLFANAVLRAQHLHQLAADTYKEFERAYIPEGQRYSIQNA QTAFCFSETIPAPTGKEEAQQRSDMELLRFSLLLIQSWLGPVQFLSRIFT NSLMFGTSDRVYEKLKDLEEGIQALMQELEDGSPRVGQILKQTYDKF DTNMRSDDALLKNYGLLSCFKKDLHKAETYLRV MKCRRFVESSCAF |

TABLE 1-continued

Growth hormone amino acid sequences from animal species

| Species GH | SEQ ID NO: | Amino Acid Sequence |
|---|---|---|
| Mole rat | 18 | FPAMPLSNLFANAVLRAQHLHQLAADTYKEFERAYIPEGQRYSIQNA<br>QAAFCFSETIPAPTGKEEAQQRSDMELLRFSLLLIQSWLGPVQFLSRVF<br>TNSLVFGTSDRVFEKLKDLEEGIQALMRELEDGSLRAGQLLKQTYDK<br>FDTNMRSDDALLKNYGLLSCFKKDLHKAETYLRV<br>MKCRRFVESSCAF |
| Guinea pig | 19 | FPAMPLSSLFGNAVLRAQHLHQLAADTYKEFERTYIPEGQRYSIHNTQ<br>TAFCFSETIPAPTDKEEAQQRSDVELLHFSLLLIQSWLGPVQFLSRVFT<br>NSLVFGTSDRVYEKLKDLEEGIQALMRELEDGTPRAGQILKQTYDKF<br>DTNLRSNDALLKNYGLLSCFRKDLHRTETYLRV MKCRRFVESSCAF |
| Ox | 20 | AFPAMSLSGLFANAVLRAQHLHQLAADTFKEFERTYIPEGQRYSIQNT<br>QVAFCFSETIPAPTGKNEAQQKSDLELLRISLLLIQSWLGPLQFLSRVF<br>TNSLVFGTSDRVYEKLKDLEEGILALMRELEDGTPRAGQILKQTYDKF<br>DTNMRSDDALLKNYGLLSCFRKDLHKTETYLRV MKCRRFGEASCAF |
| Sheep/Goat | 21 | AFPAMSLSGLFANAVLRAQHLHQLAADTFKEFERTYIPEGQRYSIQNT<br>QVAFCFSETIPAPTGKNEAQQKSDLELLRISLLLIQSWLGPLQFLSRVF<br>TNSLVFGTSDRVYEKLKDLEEGILALMRELEDVTPRAGQILKQTYDKF<br>DTNMRSDDALLKNYGLLSCFRKDLHKTETYLRV MKCRRFGEASCAF |
| Red deer | 22 | FPAMSLSGLFANAVLRAQHLHQLAADTFKEFERTYIPEGQRYSIQNTQ<br>VAFCFSETIPAPTGKNEAQQKSDLELLRISLLLIQSWLGPLQFLSRVFT<br>NSLVFGTSDRVYEKLKDLEEGILALMRELEDGTPRAGQILKQTYDKF<br>DTNMRSDDALLKNYGLLSCFRKDLHKTETYLRV MKCRRFGEASCAF |
| Giraffe | 23 | AFPAMSLSGLFANAVLRAQHLHQLAADTFKEFERTYIPEGQRYSIQNT<br>QVAFCFSETIPAPTGKNEAQQKSDLELLRISLLLIQSWLGPLQFLSRVFS<br>NSLVFGTSDRVYEKLKDLEEGILALMRELEDGTPRAGQILKQTYDKF<br>DTNMRSDDALLKNYGLLSCFRKDLHKTETYLRV MKCRRFGEASCAF |
| Chevrotain-1 | 24 | FPAMSLSGLFANAVLRVQHLHQLAADTFKEFERTYIPEGQRYSIQNTQ<br>VAFCFSETIPAPTGKNEAQQKSDLELLRISLLLIQSWLGPLQFLSRVFT<br>NSLVFGTSDRVYEKLKDLEEGILALMRELEDGPPRAGQILKQTYDKF<br>DTNMRSDDALLKNYGLLSCFRKDLHKTETYLRV MKCRRFGEASCAF |
| Slow loris | 25 | FPAMPLSSLFANAVLRAQHLHQLAADTYKEFERAYIPEGQRYSIQNA<br>QAAFCFSETIPAPTGKDEAQQRSDMELLRFSLLLIQSWLGPVQLLSRV<br>FTNSLVLGTSDRVYEKLKDLEEGIQALMRELEDGSPRVGQILKQTYD<br>KFDTNLRSDDALLKNYGLLSCFKKDLHKAETYLRV<br>MKCRRFVESSCAF |
| Marmoset | 26 | FPTIPLSRLLDNAMLRAHRLHQLAFDTYQEFEEAYIPKEQKYSFLQNP<br>QTSLCFSESIPTPASKKETQQKSNLELLRMSLLLIQSWFEPVQFLRSVF<br>ANSLLYGVSDSDVYEYLKDLEEGIQTLMGRLEDGSPRTGEIFMQTYR<br>KFDVNSQNNDALLKNYGLLYCFRKDMDKVETFLRI VQCR-<br>SVEGSCGF |
| BrTailed<br>Possum | 27 | FPAMPLSSLFANAVLRAQHLHQLVADTYKEFERTYIPEAQRHSIQSTQ<br>TAFCFSETIPAPTGKDEAQQRSDVELLRFSLLLIQSWLSPVQFLSRVFT<br>NSLVFGTSDRVYEKLRDLEEGIQALMQELEDGSSRGGLVLKTTYDKF<br>DTNLRSDEALLKNYGLLSCFKKDLHKAETYLRV MKCRRFVESSCAF |
| Monkey<br>(rhesus) | 28 | FPTIPLSRLFDNAMLRAHRLHQLAFDTYQEFEEAYIPKEQKYSFLQNP<br>QTSLCFSESIPTPSNREETQQKSNLELLRISLLLIQSWLEPVQFLRSVFA<br>NSLVYGTSYSDVYDLLKDLEEGIQTLMGRLEDGSSRTGQIFKQTYSKF<br>DTNSHNNDALLKNYGLLYCFRKDMDKIETFLRI VQCR-SVEGSCGF |
| Bovine<br>(*Bos*<br>*Taurus*) | 669 | FPAMSLSGLFANAVLRAQHLHQLAADTFKEFERTYIPEGQRYSIQNTQ<br>VAFCFSETIPAPTGKNEAQQKSDLELLRISLLLIQSWLGPLQFLSRVFT<br>NSLVFGTSDRVYEKLKDLEEGILALMRELEDGTPRAGQILKQTYDKF<br>DTNMRSDDALLKNYGLLSCFRKDLHKTETYLRVMKCRRFGEASCAF |
| Bovine<br>(U.S. Pat. No.<br>5,089,473) | 670 | FPAMSLSGLFANAVLRAQHLHQLAADTFKEFERTYIPEGQRYSIQNTQ<br>VAFCFSETIPAPTGKNEAQQKSDLELLRISLLLIQSWLGPLQFLSRVFT<br>QSLVFGTSDRVYEKLKDLEEGILALMRELEDGTPRAGQILKQTYDKF<br>DTNMRSDDALLKNYGLLSCFRKDLHKTETYLRVMKCRRFGEASCAF |
| Bovine<br>(U.S. Pat. No.<br>5,089,473) | 671 | FPAMSLSGLFANAVLRAQHLHQLAADTFKEFERTYIPEGQRYSIQNTQ<br>VAFCFSETIPAPTGKNEAQQKSDLELLRISLLLIQSWLGPLQFLSRVFT<br>QSLVFGTSDRVYEKLKDLEEGILALMREVEDGTPRAGQILKQTYDKF<br>DTNMRSDDALLKNYGLLSCFRKDLHKTETYLRVMKCRRFGEASCAF |
| Chicken<br>(*Gallus* | 672 | FPAMPLSNLFANAVLRAQHLHLLAAETYKEFERTYIPEDQRYTNKNS<br>QAAFCYSETIPAPTGKDDAQQKSDMELLRFSLVLIQSWLTPVQYLSKV |

TABLE 1-continued

Growth hormone amino acid sequences from animal species

| Species GH | SEQ ID NO: | Amino Acid Sequence |
|---|---|---|
| gallus) | | FTNNLVFGTSDRVFEKLKDLEEGIQALMRELEDRSPRGPQLLRPTYDK<br>FDIHLRNEDALLKNYGLLSCFKKDLHKVETYLKVMKCRRFGESNCTI |
| Turkey<br>(Meleagris<br>gallopavo) | 673 | FPTMPLSNLFTNAVLRAQHLHLLAAETYKEFERTYIPEDQRYTNKNSQ<br>AAFCYSETIPAPTGKDDAQQKSDMELLRFSLVLIQSWLTPMQYLSKVF<br>TNNLVFGTSDRVFEKLKDLEEGIQALMRELEDRSPRGPQLLRPTYDRF<br>DIHLRSEDALLKNYGLLSCFKKDLHKVETYLKVMKCRRFGESNCNI |
| Pig<br>(Sus<br>scrofa) | 674 | FPTMPLSSLFANAVLRAQHLHQLAADTYKEFERAYIPEGQRYSIQNAQ<br>AAFCFSETIPAPTGKDEAQQRSDVELLRFSLLLIQSWLGPVQFLSRVFT<br>NSLVFGTSDRVYEKLKDLEEGIQALMRELEDGSPRAGQILKQTYDKF<br>DTNLRSDDALLKNYGLLSCFKKDLHKAETYLRVMKCRRFVESSCAF |

III). Growth Hormone Fusion Protein Compositions

The present invention relates in part to fusion protein compositions comprising a growth hormone (GH). In one aspect, the invention provides isolated monomeric fusion proteins of GH comprising the full-length sequence or sequence variants of GH covalently linked to extended recombinant recombinant polypeptides ("XTEN" or "XTENs"). As described more fully below, the fusion proteins optionally include spacer sequences that further comprise cleavage sequences to release the GH from the fusion protein when acted on by a protease, releasing GH from the XTEN sequence(s).

In one aspect, the invention provides an isolated fusion protein comprising at least a first biologically active growth hormone protein covalently linked to one or more extended recombinant polypeptides ("XTEN"), resulting in a growth hormone-XTEN fusion protein composition (hereinafter "GHXTEN"). In one embodiment, the growth hormone is bovine growth hormone (bGH) or a sequence variant of bGH. As described more fully below, the fusion proteins optionally include spacer sequences that further comprise cleavage sequences to release the GH from the fusion protein when acted on by a protease.

The term "GHXTEN", as used herein, is meant to encompass fusion polypeptides that comprise one or more payload regions each comprising a biologically active GH that mediates one or more biological or therapeutic activities associated with growth hormone and at least one other region comprising at least a first XTEN polypeptide that serves as a carrier.

The GH of the animal compositions, particularly those disclosed in Table 1, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given GH (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a GH to create GHXTEN constructs contemplated by the invention using methods known in the art and/or in conjunction with the guidance and methods provided herein, and described more fully in the Examples.

The GH for inclusion in the GHXTEN of the invention includes any growth hormone or sequence variant of biologic, therapeutic, prophylactic, or diagnostic interest or function, or that is useful for mediating a physiologic effect or condition associated with growth hormone when administered to an animal. Of particular interest are GHXTEN fusion protein compositions for which an increase in a pharmacokinetic parameter, increased solubility, increased stability, or some other enhanced pharmaceutical property compared to native GH is sought, or for which increasing the terminal half-life would improve efficacy, safety, or result in reduce dosing frequency and/or improved economic considerations. Thus, the GHXTEN fusion protein compositions can exhibit improved efficacy of the bioactive GH by, for example, increasing the in vivo exposure or the length of time that the GHXTEN remains within the therapeutic window when administered to an animal, compared to a GH not linked to XTEN.

In one embodiment, the GH incorporated into the animal compositions can be a recombinant polypeptide with a sequence corresponding to a protein found in nature. In another embodiment, the GH is a sequence variant, fragment, homolog, or mimetic of a natural sequence that retain at least a portion of the biological activity of the native GH. In non-limiting examples, a GH is a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a protein sequence selected from Table 1. In one embodiment, a GHXTEN fusion protein comprises a single GH molecule linked to an XTEN (as described more fully below). In another embodiment, the GHXTEN comprises a first GH and a second molecule of the same GH, resulting in a fusion protein comprising the two GH linked to one or more XTEN (for example, or two molecules of bGH). In some cases of the foregoing embodiments, the GH and XTEN components are of an N- to C-terminus configuration selected from Table 5. In another embodiment, the GHXTEN fusion protein comprises a single GH molecule linked to a first and a second XTEN, with an N- to C-terminus configuration of XTEN-GH-XTEN, in which the GH is a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a protein sequence selected from Table 1, and the first and/or the second XTEN are sequences that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence selected from Table 3.

In general, the GH fusion partner component of the GHXTEN exhibits a binding specificity to a given target or another desired biological characteristic when used in vivo or when utilized in an in vitro assay. For example, the GHXTEN is an agonist, having the ability to bind to a transmembrane receptor for growth hormone. In one embodiment, the binding of GHXTEN to growth receptor leads to receptor dimerization and lead to at least a portion of the activation of intercellular signal transduction pathway compared to native growth hormone. In one embodiment, the GHXTEN bound to a transmembrane receptor for growth hormone would exhibit at least about 1%, or about 5%, or about 10%, or about 15%, or about 20%, or about 25%, or about 30%, or about 40%, or about 50%, or about 60%, or about 70%, or about 80%, or about 90%, or at least about 95% of the activation of intercellular signal transduction pathway compared to native growth hormone not linked to XTEN.

The animal GHXTEN of the present invention exhibits an enhancement of one or more pharmacokinetic parameters, which optionally is enhanced by release of GH from the fusion protein by cleavage of a spacer sequence. The GHXTEN with enhanced pharmacokinetic parameters permits less frequent dosing or an enhanced pharmacologic effect, such as but not limited to maintaining the biologically active GHXTEN within the therapeutic window between the minimum effective dose or blood concentration ($C_{min}$) and the maximum tolerated dose or blood concentration ($C_{max}$). In such cases, the linking of the GH to a fusion protein comprising a select XTEN sequence(s) can result in an improvement in these properties, making them more useful agents compared to GH not linked to XTEN.

IV). XTENded Recombinant Polypeptides

In one aspect, the invention provides XTEN polypeptide compositions that are useful as a fusion protein partner to which GH is linked, resulting in a GHXTEN fusion protein. XTEN are generally extended length polypeptides with non-naturally occurring, substantially non-repetitive sequences that are composed mainly of small hydrophilic amino acids, with the sequence having a low degree or no secondary or tertiary structure under physiologic conditions.

XTENs have utility as a fusion protein partners partner in that they serve as a "carrier", conferring certain desirable pharmacokinetic, physicochemical and pharmaceutical properties when linked to a GH protein to a create a fusion protein. Such desirable properties include but are not limited to enhanced pharmacokinetic parameters and solubility characteristics the compositions, amongst other properties described herein. Such fusion protein compositions have utility to treat animals to result in certain growth-enhancing or pharmacologic effects. As used herein, "XTEN" specifically excludes antibodies such as whole antibodies, antibody fragments (e.g., single-chain antibodies and Fc fragments).

In some embodiments, XTEN are long polypeptides having greater than about 100 to about 3000 amino acid residues, preferably greater than 400 to about 3000 residues when used as a carrier or cumulatively when more than one XTEN unit is used in a single fusion protein. In other embodiments, when used as a linker between fusion protein components or where an increase in half-life of the fusion protein is not needed but where an increase in solubility or other physico/chemical property for the GH fusion partner component is desired, an XTEN sequence shorter than 100 amino acid residues, such as about 96, or about 84, or about 72, or about 60, or about 48, or about 36 amino acid residues are incorporated into a fusion protein composition with the GH to effect the property.

The selection criteria for the XTEN to be linked to the biologically active proteins used to create the inventive fusion proteins compositions generally relate to attributes of physical/chemical properties and conformational structure of the XTEN that is, in turn, used to confer enhanced pharmaceutical and pharmacokinetic properties to the fusion proteins compositions. The XTEN of the present invention exhibits one or more of the following advantageous properties: conformational flexibility, enhanced aqueous solubility, high degree of protease resistance, low immunogenicity, low binding to mammalian receptors, and increased hydrodynamic (or Stokes) radii; properties that make them particularly useful as fusion protein partners. Non-limiting examples of the properties of the fusion proteins comprising GH that is enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as longer terminal half-life and increased area under the curve (AUC), slower absorption after subcutaneous or intramuscular injection (compared to GH not linked to XTEN and administered by a similar route) such that the $C_{max}$ is lower, which, in turn, results in reductions in adverse effects of the GH that, collectively, results in an increased period of time that a fusion protein of a GHXTEN composition administered to an animal retains therapeutic activity.

A variety of methods and assays are known in the art for determining the physical/chemical properties of proteins such as the compositions comprising the inventive XTEN. Such properties include but are not limited to secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13.

In one embodiment, XTEN is designed to behave like a denatured peptide sequence under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides XTEN sequences that, under physiologic conditions, resemble denatured sequences that are largely devoid in secondary structure. In other cases, the XTEN sequences are substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the methods described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some embodiments, the XTEN sequences used in the inventive fusion protein compositions can have an alpha-helix percentage ranging from 0% to less than about 5% as determined by the Chou-Fasman algorithm. In other cases, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In some embodiments, the XTEN sequences of the fusion protein compositions have an alpha-helix percentage less than about 2% and a beta-sheet percentage less than about 2%. In other cases, the XTEN sequences of the fusion protein compositions have a high degree of random coil percentage, as determined by the GOR algorithm. In some embodiments, an XTEN sequence have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm.

1. Non-Repetitive Sequences

In some embodiments, XTEN sequences of the compositions are substantially non-repetitive. In general, repetitive amino acid sequences have a tendency to aggregate or form higher order structures, as exemplified by natural repetitive sequences such as collagens and leucine zippers. These repetitive amino acids may also tends to form contacts resulting in crystalline or pseudocrystalline structures. In contrast, the low tendency of non-repetitive sequences to aggregate enables the design of long-sequence XTENs with a relatively low frequency of charged amino acids that would otherwise be likely to aggregate if the sequences were repetitive. Typically, the GHXTEN fusion proteins comprise XTEN sequences of greater than about 100 to about 3000 amino acid residues wherein the sequences are substantially non-repetitive. In one embodiment, the XTEN sequences have greater than about 100 to about 3000 amino acid residues in which no three contiguous amino acids in the sequence are identical amino acid types unless the amino acid is serine, in which case no more than three contiguous amino acids are serine residues. In the foregoing embodiment, the XTEN sequence would be "substantially non-repetitive."

The degree of repetitiveness of a polypeptide or a gene can be measured by computer programs or algorithms or by other means known in the art. Repetitiveness in a polypeptide sequence can, for example, be assessed by determining the number of times shorter sequences of a given length occur within the polypeptide. For example, a polypeptide of 200 amino acid residues has 192 overlapping 9-amino acid sequences (or 9-mer "frames") and 198 3-mer frames, but the number of unique 9-mer or 3-mer sequences will depend on the amount of repetitiveness within the sequence. A score is generated (hereinafter "subsequence score") that is reflective of the degree of repetitiveness of the subsequences in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 44. In some embodiments, the present invention provides GHXTEN each comprising one or more XTEN in which the XTEN has a subsequence score less than 12, more preferably less than 10, more preferably less than 9, more preferably less than 8, more preferably less than 7, more preferably less than 6, and most preferably less than 5. In the embodiments hereinabove described in this paragraph, an XTEN with a subsequence score less than about 10 (i.e., 9, 8, 7, etc.) is "substantially non-repetitive."

The non-repetitive characteristic of XTEN imparts a GH fusion proteins a greater degree of solubility and less tendency to aggregate compared to polypeptides having repetitive sequences. These properties facilitate the formulation of XTEN-comprising pharmaceutical preparations containing extremely high drug concentrations, in some cases exceeding 100 mg/ml.

Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345: 1365-71; Hsu, C. T., et al. (2000) Cancer Res, 60:3701-5); Bachmann M F, et al. Eur J Immunol (1995) 25(12):3445-3451).

2. Exemplary Sequence Motifs

The present invention encompasses XTEN used as fusion partners that comprise multiple units of shorter sequences, or motifs, in which the amino acid sequences of the motifs are non-repetitive. The non-repetitive criterion can be met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is rendered substantially non-repetitive.

In one embodiment, XTEN have a non-repetitive sequence of greater than about 100 to about 3000 amino acid residues wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly of small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 100 to about 3000 amino acid residues, preferably greater than 400 to about 3000 residues in length. In some embodiments, XTEN has greater than about 100 to about 3000 amino acid residues wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 100 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences would be substantially non-repetitive.

In some embodiments, the invention provides compositions comprising non-repetitive XTEN sequence(s) of greater than about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 2. In some embodiments, the XTEN comprises non-overlapping sequence motifs in which about 80%, or at least about 90%, or about 91%, or about 92%, or about 93%, or about 94%, or about 95%, or about 96%, or about 97%, or about 98%, or about 99% to about 100% of the sequence consists of two or more non-overlapping sequences selected from a single motif family of Table 2, resulting in a "family" sequence in which the overall sequence remains substantially non-repetitive. Accordingly, in these embodiments, an XTEN sequence comprises multiple units of non-overlapping sequence motifs of the AD motif family, or the AE motif family, or the AF motif family, or the AG motif family, or the AM motif family, or the AQ motif family, or the BC family, or the BD family of sequences of Table 2. In other embodiments, the XTEN comprises motif sequences from two or more of the motif families of Table 2.

TABLE 2

XTEN Sequence Motifs of 12 Amino Acids and Motif Families

| Motif Family* | SEQ ID NO: | MOTIF SEQUENCE |
|---|---|---|
| AD | 29 | GESPGGSSGSES |
| AD | 30 | GSEGSSGPGESS |
| AD | 31 | GSSESGSSEGGP |
| AD | 32 | GSGGEPSESGSS |
| AE, AM | 33 | GSPAGSPTSTEE |
| AE, AM, AQ | 34 | GSEPATSGSETP |
| AE, AM, AQ | 35 | GTSESATPESGP |
| AE, AM, AQ | 36 | GTSTEPSEGSAP |
| AF, AM | 37 | GSTSESPSGTAP |
| AF, AM | 38 | GTSTPESGSASP |
| AF, AM | 39 | GTSPSGESSTAP |
| AF, AM | 40 | GSTSSTAESPGP |
| AG, AM | 41 | GTPGSGTASSSP |
| AG, AM | 42 | GSSTPSGATGSP |
| AG, AM | 43 | GSSPSASTGTGP |
| AG, AM | 44 | GASPGTSSTGSP |
| AQ | 45 | GEPAGSPTSTSE |
| AQ | 46 | GTGEPSSTPASE |
| AQ | 47 | GSGPSTESAPTE |
| AQ | 48 | GSETPSGPSETA |
| AQ | 49 | GPSETSTSEPGA |
| AQ | 50 | GSPSEPTEGTSA |
| BC | 51 | GSGASEPTSTEP |
| BC | 52 | GSEPATSGTEPS |
| BC | 53 | GTSEPSTSEPGA |
| BC | 54 | GTSTEPSEPGSA |
| BD | 55 | GSTAGSETSTEA |
| BD | 56 | GSETATSGSETA |
| BD | 57 | GTSESATSESGA |
| BD | 58 | GTSTEASEGSAS |

*Denotes individual motif sequences that, when used together in various permutations, results in a "family sequence"

In other embodiments, the GHXTEN composition comprises a non-repetitive XTEN sequence of greater than about 100 to about 3000 amino acid residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 8-11.

In those embodiments wherein the XTEN component of the GHXTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs of Table 2, or less than 100% sequence identity with an XTEN from Table 3, the other amino acid residues are selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the GHXTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain few (e.g. less than 5%) or none of the following amino acids: cysteine (to avoid disulfide formation and oxidation), methionine (to avoid oxidation), asparagine and glutamine (to avoid desamidation). Thus, in some embodiments, the XTEN component of the GHXTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect of the present invention, the invention encompasses GHXTEN compositions comprising carriers of XTEN polypeptides with extended length sequences. The present invention makes use of the discovery that increasing the length of non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a fixed repeat order of single family sequence motifs (e.g., the four AE motifs of Table 2), result in a sequence with a higher percentage of random coil formation, as determined by GOR algorithm, compared to shorter XTEN lengths. In general, increasing the length of the unstructured polypeptide fusion partner, as described in the Examples, results in a fusion protein with a disproportional increase in terminal half-life compared to fusion proteins with unstructured polypeptide partners with shorter sequence lengths.

Non-limiting examples of XTEN contemplated for inclusion in the GHXTEN of the invention are presented in Table 3. In one embodiment, the invention provides GHXTEN compositions wherein the XTEN sequence length of the fusion protein(s) is greater than about 100 to about 3000 amino acid residues, and in some cases is greater than about 400 to about 3000 amino acid residues, wherein the XTEN confers enhanced pharmacokinetic properties on the GHXTEN in comparison to GH not linked to XTEN. In some embodiments, the XTEN sequences of the GHXTEN compositions of the present invention can be about 100, or about 144, or about 288, or about 401, or about 500, or about 600, or about 700, or about 800, or about 900, or about 1000, or about 1500, or about 2000, or about 2500 or up to about 3000 amino acid residues in length. In other cases, the XTEN sequences can be about 100 to 150, about 150 to 250, about 250 to 400, 401 to about 500, about 500 to 900, about 900 to 1500, about 1500 to 2000, or about 2000 to about 3000 amino acid residues in length. In one embodiment, the GHXTEN can comprise an XTEN sequence wherein the sequence exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a XTEN selected from Table 3. In some embodiments, the XTEN sequence is designed for optimized expression as the N-terminal component of the GHXTEN by inclusion of encoding nucleotides for an optimized N-terminal leader sequence (NTS) in the XTEN portion of the gene encoding the fusion protein. In one embodiment, the N-terminal XTEN sequence of the expressed GHXTEN has at least 90% sequence identity to the sequence of AE48 or AM48, AE624, or AE912 or AM923. In another embodiment, the XTEN has the N-terminal residues described in Examples 14-17.

In other embodiments, the GHXTEN fusion protein comprises a first and a second XTEN sequence, wherein the cumulative total of the residues in the XTEN sequences is greater than about 400 to about 3000 amino acid residues. In embodiments of the foregoing, the GHXTEN fusion protein comprises a first and a second XTEN sequence wherein the sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to at least a first or additionally a second XTEN selected from Table 3. Examples where more than one XTEN is used in a GHXTEN composition include, but are not limited to constructs with an XTEN linked to both the N- and C-termini of at least one GH.

As described more fully below, the invention provides methods in which the GHXTEN is designed by selecting the length of the XTEN to confer a target half-life on a fusion protein administered to an animal. In general, XTEN lengths longer that about cumulative 400 residues incorporated into the GHXTEN compositions result in longer half-life compared to shorter cumulative lengths; e.g., shorter than about 280 residues. However, in another embodiment, GHXTEN fusion proteins are designed to comprise XTEN with a longer sequence length that is selected to additionally confer slower rates of systemic absorption after subcutaneous or intramuscular administration to an animal. In such embodiments, the $C_{max}$ is reduced in comparison to a comparable dose of a GH not linked to XTEN, thereby contributing to the ability to keep the GHXTEN within the therapeutic window for the composition. Thus, the XTEN confers the property of a depot to the administered GHXTEN, in addition to the other physical/chemical properties described herein.

TABLE 3

XTEN Polypeptides

| XTEN Name | SEQ ID NO: | Amino Acid Sequence |
|---|---|---|
| AE48 | 59 | MAEPAGSPTSTEEGTPGSGTASSSPGSSTPSGATGSPGASPGTSSTGS |
| AM48 | 60 | MAEPAGSPTSTEEGASPGTSSTGSPGSSTPSGATGSPGSSTPSGATGS |
| AE144 | 61 | GSEPATSGSETPGTSESATPESGPGSEPATSGSETPGSPAGSPTSTEEGTSTEPS<br>EGSAPGSEPATSGSETPGSEPATSGSETPGSEPATSGSETPGTSTEPSEGSAPGT<br>SESATPESGPGSEPATSGSETPGTSTEPSEGSAP |
| AF144 | 62 | GTSTPESGSASPGTSPSGESSTAPGTSPSGESSTAPGSTSSTAESPGPGSTSESPS<br>GTAPGSTSSTAESPGPGTSPSGESSTAPGTSTPESGSASPGSTSSTAESPGPGTS<br>PSGESSTAPGTSPSGESSTAPGTSPSGESSTAP |
| AE288 | 63 | GTSESATPESGPGSEPATSGSETPGTSESATPESGPGSEPATSGSETPGTSESAT<br>PESGPGTSTEPSEGSAPGSPAGSPTSTEEGTSESATPESGPGSEPATSGSETPGT<br>SESATPESGPGSPAGSPTSTEEGSPAGSPTSTEEGTSTEPSEGSAPGTSESATPE<br>SGPGTSESATPESGPGTSESATPESGPGSEPATSGSETPGSEPATSGSETPGSPA<br>GSPTSTEEGTSTEPSEGSAPGTSTEPSEGSAPGSEPATSGSETPGTSESATPESG<br>PGTSTEPSEGSAP |
| AF504 | 64 | GASPGTSSTGSPGSSPSASTGTGPGSSPSASTGTGPGTPGSGTASSSPGSSTPSG<br>ATGSPGSXPSASTGTGPGASPGTSSTGSPGTPGSGTASSSPGSSTPSGATGSPG<br>TPGSGTASSSPGASPGTSSTGSPGASPGTSSTGSPGTPGSGTASSSPGSSTPSGA<br>TGSPGASPGTSSTGSPGTPGSGTASSSPGSSTPSGATGSPGSXPSASTGTGPGSS<br>PSASTGTGPGSSTPSGATGSPGSSTPSGATGSPGASPGTSSTGSPGASPGTSST<br>GSPGASPGTSSTGSPGTPGSGTASSSPGASPGTSSTGSPGASPGTSSTGSPGASP<br>GTSSTGSPGSSPSASTGTGPGTPGSGTASSSPGASPGTSSTGSPGASPGTSSTGS<br>PGASPGTSSTGSPGSSTPSGATGSPGSSTPSGATGSPGASPGTSSTGSPGTPGSG<br>TASSSPGSSTPSGATGSPGSSTPSGATGSPGSSTPSGATGSPGSSPSASTGTGPG<br>ASPGTSSTGSP |
| AF540 | 65 | GSTSSTAESPGPGSTSSTAESPGPGSTSESPSGTAPGSTSSTAESPGPGSTSSTA<br>ESPGPGTSTPESGSASPGTSESPSGTAPGTSPSGESSTAPGSTSESPSGTAPGST<br>SESPSGTAPGTSPSGESSTAPGSTSESPSGTAPGSTSESPSGTAPGTSPSGESSTA<br>PGSTSESPSGTAPGSTSESPSGTAPGSTSESPSGTAPGTSTPESGSASPGSTSESP<br>SGTAPGTSTPESGSASPGSTSSTAESPGPGSTSSTAESPGPGTSTPESGSASPGT<br>STPESGSASPGSTSESPSGTAPGTSTPESGSASPGTSTPESGSASPGSTSESPSGT |

TABLE 3-continued

XTEN Polypeptides

| XTEN Name | SEQ ID NO: | Amino Acid Sequence |
|---|---|---|
| | | APGSTSESPSGTAPGSTSESPSGTAPGSTSSTAESPGPGTSTPESGSASPGTSTP<br>ESGSASPGSTSESPSGTAPGSTSESPSGTAPGTSTPESGSASPGSTSESPSGTAP<br>GSTSESPSGTAPGTSTPESGSASPGTSPSGESSTAPGSTSSTAESPGPGTSPSGES<br>STAPGSTSSTAESPGPGTSTPESGSASPGSTSESPSGTAP |
| AD576 | 66 | GSSESGSSEGGPGSGGEPSESGSGSSESGSSEGGPGSSESGSSEGGPGSSESGS<br>SEGGPGSSESGSSEGGPGSSESGSSEGGPGESPGGSSGSESGSEGSSGPGESSGS<br>SESGSSEGGPGSSESGSSEGGPGSSESGSSEGGPGSGGEPSESGSSGESPGGSSG<br>SESGESPGGSSGSESGSSGGEPSESGSSGSSESGSSEGGPGSGGEPSESGSSGSGG<br>EPSESGSSGSEGSSGPGESSGESPGGSSGSESGSGGEPSESGSSGSGGEPSESGS<br>SGSGGEPSESGSSGSSESGSSEGGPGESPGGSSGSESGESPGGSSGSESGESPGG<br>SSGSESGESPGGSSGSESGESPGGSSGSESGSSESGSSEGGPGSGGEPSESGSSG<br>SEGSSGPGESSGSSESGSSEGGPGSGGEPSESGSSGSSESGSSEGGPGSGGEPSE<br>SGSSGESPGGSSGSESGESPGGSSGSESGSSESGSSEGGPGSGGEPSESGSSGSS<br>ESGSSEGGPGSGGEPSESGSSGSGGEPSESGSSGESPGGSSGSESGSEGSSGPG<br>ESSGSSESGSSEGGPGSEGSSGPGESS |
| AE576 | 67 | GSPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPGS<br>PAGSPTSTEEGTSESATPESGPGTSTEPSEGSAPGTSTEPSEGSAPGSPAGSPTS<br>TEEGTSTEPSEGSAPGTSTEPSEGSAPGTSESATPESGPGTSTEPSEGSAPGTSE<br>SATPESGPGSEPATSGSETPGTSTEPSEGSAPGTSTEPSEGSAPGTSESATPESG<br>PGTSESATPESGPGSPAGSPTSTEEGTSESATPESGPGSEPATSGSETPGTSESA<br>TPESGPGTSTEPSEGSAPGTSTEPSEGSAPGTSTEPSEGSAPGTSTEPSEGSAPG<br>TSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTS<br>TEPSEGSAPGTSESATPESGPGSPAGSPTSTEEGSPAGSPTSTEEGSPAGSPTST<br>EEGTSESATPESGPGTSTEPSEGSAP |
| AF576 | 68 | GSTSSTAESPGPGSTSSTAESPGPGSTSESPSGTAPGSTSSTAESPGPGSTSSTA<br>ESPGPGTSTPESGSASPGSTSESPSGTAPGTSPSGESSTAPGSTSESPSGTAPGST<br>SESPSGTAPGTSPSGESSTAPGSTSESPSGTAPGSTSESPSGTAPGTSPSGESSTA<br>PGSTSESPSGTAPGSTSESPSGTAPGSTSESPSGTAPGTSTPESGSASPGSTSESP<br>SGTAPGTSTPESGSASPGSTSSTAESPGPGSTSSTAESPGPGTSTPESGSASPGT<br>STPESGSASPGSTSESPSGTAPGTSTPESGSASPGTSTPESGSASPGSTSESPSGT<br>APGSTSESPSGTAPGSTSESPSGTAPGSTSSTAESPGPGTSTPESGSASPGTSTP<br>ESGSASPGSTSESPSGTAPGSTSESPSGTAPGTSTPESGSASPGSTSESPSGTAP<br>GSTSESPSGTAPGTSTPESGSASPGTSPSGESSTAPGSTSSTAESPGPGTSPSGES<br>STAPGSTSSTAESPGPGTSTPESGSASPGSTSESPSGTAPGSTSSTAESPGPGTS<br>TPESGSASPGTSTPESGSASP |
| AE624 | 69 | MAEPAGSPTSTEEGTPGSGTASSSPGSSTPSGATGSPGASPGTSSTGSPGSPAG<br>SPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSP<br>TSTEEGTSESATPESGPGTSTEPSEGSAPGTSTEPSEGSAPGSPAGSPTSTEEGT<br>STEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSE<br>SATPESGPGSPAGSPTSTEEGTSESATPESGPGSEPATSGSETPGTSESATPESG<br>PGTSTEPSEGSAPGTSTEPSEGSAPGTSTEPSEGSAPGTSTEPSEGSAPGTSTEP<br>SEGSAPGTSTEPSEGSAPGSPAGSPTSTEEGTSTEPSEGSAPGTSESATPESGPG<br>SEPATSGSETPGTSESATPESGPGSEPATSGSETPGTSESATPESGPGTSTEPSE<br>GSAPGTSESATPESGPGSPAGSPTSTEEGSPAGSPTSTEEGSPAGSPTSTEEGTS<br>ESATPESGPGTSTEPSEGSAP |
| AD836 | 70 | GSSESGSSEGGPGSSESGSSEGGPGESPGGSSGSESGSGGEPSESGSSGESPGGS<br>SGSESGESPGGSSGSESGSSESGSSEGGPGSSESGSSEGGPGSSESGSSEGGPGE<br>SPGGSSGSESGESPGGSSGSESGESPGGSSGSESGSSESGSSEGGPGSSESGSSE<br>GGPGSSESGSSEGGPGSSESGSSEGGPGSSESGSSEGGPGSSESGSSEGGPGSG<br>GEPSESGSSGESPGGSSGSESGESPGGSSGSESGSGGEPSESGSSGSEGSSGPGE<br>SSGSSESGSSEGGPGSGGEPSESGSSGSEGSSGPGESSGSSESGSSEGGPGSGGE<br>PSESGSSGESPGGSSGSESGSGGEPSESGSSGSGGEPSESGSSGSSESGSSEGGP<br>GSGGEPSESGSSGSGGEPSESGSSGSGSGPGESSGESPGSSGSEGSSGSG<br>PGESSGSEGSSGPGESSGGGEPSESGSSGSESGSGPGESSGESSGPGESSGEGSSP<br>GESSGGGEPSESGSSGSGGGEPSESGSSGESPGGSSGSESGSEGSSGPG<br>SSESGSSEGGPGSGGEPSESGSSGSEGSSGPGESSGESSGPGESSGSEGSSGP<br>GESSGGGEPSESGSSGSGGGEPSESGSSGESPGGSSGSESGSEGSPGGSSGSESGSG<br>GEPSESGSSGEGSSGPGESSGESPGGSSGSESGSSESGSSEGGPGSSESGSSEG<br>GPGSSESGSSEGGPGSGGEPSESGSSGSESGSSEGGPGESPGGSSGSESGSGG<br>EPSESGSSGSSESGSSEGGPGESPGGSSGSESGSGGEPSESGSSGESPGGSSGSE<br>SGSGGEPSESGSS |
| AE864 | 71 | GSPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPGS<br>PAGSPTSTEEGTSESATPESGPGTSTEPSEGSAPGTSTEPSEGSAPGSPAGSPTS<br>TEEGTSTEPSEGSAPGTSTEPSEGSAPGTSESATPESGPGTSTEPSEGSAPGTSE |

TABLE 3-continued

XTEN Polypeptides

| XTEN Name | SEQ ID NO: | Amino Acid Sequence |
|---|---|---|
| | | SATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESA TPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATP ESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEE GTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGS EPATSGSETPGSEPATSGSETPGSPAGSPTSTEEGTSTEPSEGSAPGTSTEPSEG SAPGSEPATSGSETPGTSESATPESGPGTSTEPSEGSAP |
| AF864 | 72 | GSTSESPSGTAPGTSPSGESSTAPGSTSESPSGTAPGSTSESPSGTAPGTSTPES GSASPGTSTPESGSASPGSTSESPSGTAPGSTSESPSGTAPGTSPSGESSTAPGS TSESPSGTAPGTSPSGESSTAPGTSPSGESSTAPGSTSSTAESPGPGTSPSGESST APGTSPSGESSTAPGSTSSTAESPGPGTSTPESGSASPGTSTPESGSASPGSTSES PSGTAPGSTSESPSGTAPGTSTPESGSASPGSTSSTAESPGPGTSTPESGSASPG STSESPSGTAPGTSPSGESSTAPGSTSSTAESPGPGTSPSGESSTAPGTSTPESGS ASPGSTSSTAESPGPGTSSTAESPGPGTSTSTAESPGPGTSPSGESSTAPGTSPS GESSTAPGSTSESPSGTAPGSTSESPSGTAPGTSTPESGPXXXGASASGAPSTX XXXSESPSGTAPGSTSESPSGTAPGSTSESPSGTAPGSTSESPSGTAPGSTSESP SGTAPGSTSESPSGTAPGTSTPESGSASPGTSPSGESSTAPGTSPSGESSTAPGS TSSTAESPGPGTSPSGESSTAPGTSTPESGSASPGSTSESPSGTAPGSTSESPSGT APGTSPSGESSTAPGSTSESPSGTAPGTSTPESGSASPGTSTPESGSASPGSTSES PSGTAPGTSTPESGSASPGSTSSTAESPGPGSTSESPSGTAPGSTSESPSGTAPG TSPSGESSTAPGSTSSTAESPGPGTSPSGESSTAPGTSTPESGSASPGTSPSGESS TAPGTSPSGESSTAPGTSPSGESSTAPGSTSSTAESPGPGTSSTAESPGPGTSPS GESSTAPGSSPSASTGTGPGSSTPSGATGSPGSSTPSGATGSP |
| AG864 | 73 | GASPGTSSTGSPGSSPSASTGTGPGSSPSASTGTGPGTPGSGTASSSPGSSTPSG ATGSPGSSPSASTGTGPGASPGTSSTGSPGTPGSGTASSSPGSSTPSGATGSPG TPGSGTASSSPGASPGTSSTGSPGASPGTSSTGSPGTPGSGTASSSPGSSTPSGA TGSPGASPGTSSTGSPGTPGSGTASSSPGSSTPSGATGSPGSSPSASTGTGPGSS PSASTGTGPGSSTPSGATGSPGSSTPSGATGSPGASPGTSSTGSPGASPGTSST GSPGASPGTSSTGSPGTPGSGTASSSPGASPGTSSTGSPGASPGTSSTGSPGASP GTSSTGSPGSSPSASTGTGPGTPGSGTASSSPGASPGTSSTGSPGASPGTSSTGS PGASPGTSSTGSPGSSTPSGATGSPGSSTPSGATGSPGASPGTSSTGSPGTPGSG TASSSPGSSTPSGATGSPGSSTPSGATGSPGSSTPSGATGSPGSSPSASTGTGPG ASPGTSSTGSPGASPGTSSTGSPGTPGSGTASSSPGASPGTSSTGSPGASPGTSS TGSPGASPGTSSTGSPGASPGTSSTGSPGTPGSGTASSSPGSSTPSGATGSPGTP GSGTASSSPGSSTPSGATGSPGTPGSGTASSSPGSSTPSGATGSPGSSTPSGATG SPGSSPSASTGTGPGSSPSASTGTGPGASPGTSSTGSPGTPGSGTASSSPGSSTP SGATGSPGSSPSASTGTGPGSSPSASTGTGPGASPGTSSTGSPGASPGTSSTGSP GSSTPSGATGSPGSSPSASTGTGPGASPGTSSTGSPGSSPSASTGTGPGTPGSG TASSSPGSSTPSGATGSPGSSTPSGATGSPGASPGTSSTGSP |
| AM875 | 74 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGASASG APSTGGTSESATPESGPGSPAGSPTSTEEGSPAGSPTSTEEGTSSTAESPGPGS TSESPSGTAPGSPSGESSTAPGTPGSGTASSSPGSSTPSGATGSPGSSPSASTG TGPGSEPATSGSETPGTSESATPESGPGSEPATSGSETPGTSSTAESPGPGSTS STAESPGPGTSPSGESSTAPGSEPATSGSETPGSEPATSGSETPGTSTEPSEGSA PGSTSSTAESPGPGTSTPESGSASPGSTSESPSGTAPGTSTEPSEGSAPGTSTEPS EGSAPGTSTEPSEGSAPGSSTPSGATGSPGSSPSASTGTGPGASPGTSSTGSPGS EPATSGSETPGTSESATPESGPGSPAGSPTSTEEGSSTPSGATGSPGSSPSASTG TGPGASPGTSSTGSPGTSESATPESGPGTSTEPSEGSAPGTSTEPSEGSAP |
| AE912 | 75 | MAEPAGSPTSTEEGTPGSGTASSSPGSSTPSGATGSPGASPGTSSTGSPGSPAG SPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGT STEPSEGSAPGTSTEPSEGSAPGTSESATPESGPGTSTEPSEGSAPGTSESATPE SGPGSEPATSGSETPGTSTEPSEGSAPGTSTEPSEGSAPGTSESATPESGPGTSE SATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATPESGPG SEPATSGSETPGTSESATPESGPGSEPATSGSETPGTSESATPESGPGTSTEPSE GSAPGTSESATPESGPGSPAGSPTSTEEGSPAGSPTSTEEGSPAGSPTSTEEGTS |

TABLE 3-continued

XTEN Polypeptides

| XTEN Name | SEQ ID NO: | Amino Acid Sequence |
|---|---|---|
| | | ESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEE GTSTEPSEGSAPGTSESATPESGPGTSESATPESGPGTSESATPESGPGSEPATS GSETPGSEPATSGSETPGSPAGSPTSTEEGTSTEPSEGSAPGTSTEPSEGSAPGS EPATSGSETPGTSESATPESGPGTSTEPSEGSAP |
| AM923 | 76 | MAEPAGSPTSTEEGASPGTSSTGSPGSSTPSGATGSPGSSTPSGATGSPGTSTE PSEGSAPGSEPATSGSETPGSPAGSPTSTEEGSTSSTAESPGPGTSTPESGSASP GSTSESPSGTAPGSTSESPSGTAPGTSTPESGSASPGTSTPESGSASPGSEPATS GSETPGTSESATPESGPGSPAGSPTSTEEGTSTEPSEGSAPGTSESATPESGPGT STEPSEGSAPGTSTEPSEGSAPGSPAGSPTSTEEGTSTEPSEGSAPGTSTEPSEG SAPGTSESATPESGPGTSESATPESGPGTSTEPSEGSAPGTSTEPSEGSAPGTSE SATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPAT SGSETPGSPAGSPTSTEEGSPAGSPTSTEEGSTSTEPSEGSAPGASASGAPSTGG TSESATPESGPGSPAGSPTSTEEGSPAGSPTSTEEGSTSSTAESPGPGSTSESPSG TAPGTSPSGESSTAPGTPGSGTASSSPGSSTPSGATGSPGSSPSASTGTGPGSEP ATSGSETPGTSESATPESGPGSEPATSGSETPGSTSSTAESPGPGSTSSTAESPG PGTSPSGESSTAPGSEPATSGSETPGSEPATSGSETPGTSTEPSEGSAPGTSSST AESPGPGTSTPESGSASPGSTSESPSGTAPGTSTEPSEGSAPGTSTEPSEGSAPG TSTEPSEGSAPGSSTPSGATGSPGSSPSASTGTGPGASPGTSSTGSPGSEPATSG SETPGTSESATPESGPGSPAGSPTSTEEGSSTPSGATGSPGSSPSASTGTGPGAS PGTSSTGSPGTSESATPESGPGTSTEPSEGSAPGTSTEPSEGSAP |
| AM1318 | 77 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSESGSAPGPEPTGP APSGGSEPATSGSETPGTSESATPESGPGSPAGSPTSTEEGTSESATPESGPGSP AGSPTSTEEGSPAGSPTSTEEGTSESATPESGPGSPAGSPTSTEEGSPAGSPTST EEGSTSSTAESPGPGSTSESPSGTAPGTSPSGESSTAPGSTSESPSGTAPGSTSES PSGTAPGTSPSGESSTAPGTSTEPSEGSAPGTSTSESPSGTAPGTSPSGESSTAPGTSESATPESGPGPG SEPATSGSETPGTSESATPESGPGTSESATPESGPGTSTEPSEGSAPGTSESATP ESGPGTSTEPSEGSAPGTSPSGESSTAPGTSPSGESSTAPGTSPSGESSTAPGTS TEPSEGSAPGSPAGSPTSTEEGTSTEPSEGSAPGSSPSASTGTGPGSSTPSGATG SPGSSTPSGATGSPGSSTPSGATGSPGASPGTSSTGSPGASAS GAPSTGGTSPSGESSTAPGSTSSTAESPGPGTSPSGESSTAPGTSESATPESGPG TSTEPSEGSAPGTSTEPSEGSAPGSSPSASTGTGPGSSTPSGATGSPGASPGTSS TGSPGTSTPESGSASPGTSPSGESSTAPGTSESATPESGPGSE PATSGSETPGTSTEPSEGSAPGTSESPSGTAPGTSESPSGTAPGTSTPESGSA SPGSPAGSPTSTEEGTSESATPESGPGTSTEPSEGSAPGSPAGSPTSTEEGTSES ATPESGPGSEPATSGSETPGSSTPSGATGSPGASPGTSSTGSPGSSTPSGATGSP GSTSESPSGTAPGTSPSGESSTAPGSTSSTAESPGPGSSTPSGATGSPGASPGTS STGSPGTPGSGTASSSPGSPAGSPTSTEEGSPAGSPTSTEEGTSTEPSEGSAP |
| BC 864 | 78 | GTSTEPSEPGSAGTSTEPSEPGSAGSEPATSGTEPSGSGASEPTSTEPGSEPATS GTEPSGSEPATSGTEPSGSEPATSGTEPSGSGASEPTSTEPGTSTEPSEPGSAGS EPATSGTEPSGTSTEPSEPGSAGSEPATSGTEPSGSEPATSGTEPSGTSTEPSEP GSAGTSTEPSEPGSAGSEPATSGTEPSGSEPATSGTEPSGTSEPSTSEPGAGSG ASEPTSTEPGTSEPSTSEPGAGSEPATSGTEPSGSEPATSGTEPSGTSTEPSEPGS AGTSTEPSEPGSAGSGASEPTSTEPGSEPATSGTEPSGSEPATSGTEPSGSEPAT SGTEPSGSEPATSGTEPSGTSTEPSEPGSAGSEPATSGTEPSGSGASEPTSTEPG TSTEPSEPGSAGSEPATSGTEPSGSGASEPTSTEPGTSTEPSEPGSAGSGASEPT STEPGSEPATSGTEPSGSGASEPTSTEPGSEPATSGTEPSGSGASEPTSTEPGTS TEPSEPGSAGSEPATSGTEPSGSGASEPTSTEPGTSTEPSEPGSAGSEPATSGTE PSGTSTEPSEPGSAGSEPATSGTEPSGTSTEPSEPGSAGTSTEPSEPGSAGTSTE PSEPGSAGTSTEPSEPGSAGTSTEPSEPGSAGTSTEPSEPGSAGTSEPSTSEPGA GSGASEPTSTEPGTSTEPSEPGSAGTSTEPSEPGSAGSTEPSEPGSAGSEPATS GTEPSGSGASEPTSTEPGSEPATSGTEPSGSEPATSGTEPSGSEPATSGTEPSGS EPATSGTEPSGTSEPSTSEPGAGSEPATSGTEPSGSGASEPTSTEPGTSTEPSEP GSAGSEPATSGTEPSGSGASEPTSTEPGTSTEPSEPGSA |
| BD864 | 79 | GSETATSGSETAGTSESATSESGAGSTAGSETSTEAGTSESATSESGAGSETAT SGSETAGSETATSGSETAGTSTEASEGSASGTSTEASEGSASGTSESATSESGA GSETATSGSETAGTSTEASEGSASGTAGSETSTEAGTSESATSESGAGTSESA TSESGAGSETATSGSETAGTSESATSESGAGTSTEAEGSASGSETATSGSETA GSETATSGSETAGTSTEASEGSASGTAGSETSTEAGTSESATSESGAGTSTEA SEGSASGSETATSGSETAGTAGSETSTEAGSTAGSETSTEAGSETATSGSETA GTSESATSESGAGTSESATSESGAGSETATSGSETAGTSESATSESGAGTSESA TSESGAGSETATSGSETAGSETATSGSETAGTSTEASEGSASGSTAGSETSTEA |

TABLE 3-continued

XTEN Polypeptides

| XTEN Name | SEQ ID NO: | Amino Acid Sequence |
|---|---|---|
| | | GSETATSGSETAGTSESATSESGAGSTAGSETSTEAGSTAGSETSTEAGSTAG<br>SETSTEAGTSTEASEGSASGSTAGSETSTEAGSTAGSETSTEAGTSTEASEGSA<br>SGSTAGSETSTEAGSETATSGSETAGTSTEASEGSASGTSESATSESGAGSETA<br>TSGSETAGTSESATSESGAGTSESATSESGAGSETATSGSETAGTSESATSESG<br>AGSETATSGSETAGTSTEASEGSASGTSTEASEGSASGSTAGSETSTEAGSTA<br>GSETSTEAGSETATSGSETAGTSESATSESGAGTSESATSESGAGSETATSGSE<br>TAGSETATSGSETAGSETATSGSETAGTSTEASEGSASGTSESATSESGAGSET<br>ATSGSETAGSETATSGSETAGTSESATSESGAGTSESATSESGAGSETATSGSE<br>TA |

4. XTEN Segments

In one embodiment, the invention provides an isolated GHXTEN fusion protein wherein the cumulative length of the XTEN component is greater than about 100 to about 3000 amino acid residues containing at least one polypeptide sequence segment selected from Tables 3, 8, 9, 10, 11, and 12 and wherein at least about 90%, or at least about 91%, or at least about 92%, or at least about 93%, or at least about 94%, or at least about 95%, or at least about 96%, or at least about 97%, or at least about 98% or more of the remainder of the XTEN sequence by and large contains hydrophilic amino acids and less than about 2% of the remainder of the XTEN consists of hydrophobic or aromatic amino acids, or cysteine. In some embodiments, the XTEN contains multiple segments wherein the segments are identical or different. In another embodiment, the invention provides an isolated GHXTEN fusion protein wherein the cumulative length of the XTEN component is greater than about 100 to about 3000 amino acid residues and comprises at least one sequence segment of at least about 100 to about 923, or at least about 100 to about 875, or at least about 100 to about 576, or at least about 100 to about 288, or at least about 100 to about 144 amino acid residues wherein the sequence segment(s) consists of at least three different types of amino acids and the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic or aromatic amino acids, or cysteine. In another embodiment, the invention provides an isolated GHXTEN fusion protein wherein the cumulative length of the XTEN component is greater than about 100 to about 3000 amino acid residues and comprises at least one sequence segment of at least about 200 to about 923, or at least about 200 to about 875, or at least about 200 to about 576, or at least about 200 to about 288 amino acid residues wherein the sequence segment(s) the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and wherein the subsequence score of the segment is less than 12, more preferably less than 10, more preferably less than 9, more preferably less than 8, more preferably less than 7, more preferably less than 6, and most preferably less than 5, and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In some embodiments, the invention provides a short-length XTEN sequence incorporated as the N-terminal portion of the GHXTEN fusion protein. The expression of the fusion protein is enhanced in a host cell transformed with a suitable expression vector comprising an optimized N-terminal leader polynucleotide sequence (that encodes the N-terminal XTEN) incorporated into the polynucleotide encoding the binding fusion protein. It has been discovered, as described in Examples 14-17, that a host cell transformed with such an expression vector comprising an optimized N-terminal leader sequence (NTS) in the binding fusion protein gene results in greatly-enhanced expression of the fusion protein compared to the expression of a corresponding fusion protein from a polynucleotide not comprising the NTS, and obviates the need for incorporation of a non-XTEN leader sequence used to enhance expression. In one embodiment, the invention provides GHXTEN fusion proteins comprising an NTS wherein the expression of the binding fusion protein from the encoding gene in a host cell is enhanced about 50%, or about 75%, or about 100%, or about 150%, or about 200%, or about 400% compared to expression of a GHXTEN fusion protein not comprising the N-terminal XTEN sequence (where the encoding gene lacks the NTS).

In one embodiment, the N-terminal XTEN polypeptide of the GHXTEN comprises a sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least 99%, or exhibits 100% sequence identity to the amino acid sequence of AE48 or AM48, the respective amino acid sequences of which are as follows:

AE48:
(SEQ ID NO: 80)
MAEPAGSPTSTEEGTPGSGTASSSPGSSTPSGATGSPGASPGTSSTGS

-continued

AM48:
(SEQ ID NO: 81)
MAEPAGSPTSTEEGASPGTSSTGSPGSSTPSGATGSPGSSTPSGATGS

In another embodiment, the short-length N-terminal XTEN is linked to an XTEN of longer length to form the N-terminal region of the GHXTEN fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN is linked to any of the XTEN disclosed herein (e.g., an XTEN of Table 3) and the resulting XTEN, in turn, is linked to the N-terminal of any of the GH disclosed herein (e.g., a GH of Table 1) as a component of the fusion protein. Alternatively, polynucleotides encoding the short-length XTEN (or its complement) is linked to polynucleotides encoding any of the XTEN (or its complement) disclosed herein and the resulting gene encoding the N-terminal XTEN, in turn, is linked to the 5' end of polynucleotides encoding any of the GH (or to the 3' end of its complement) disclosed herein. In some embodiments, the N-terminal XTEN polypeptide with long length exhibits at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from GESTPA, to accommodate the restriction endonuclease restriction sites that would be employed to join the nucleotides encoding the N-terminal XTEN to the gene encoding the targeting moiety of the fusion protein. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and/or reducing the proportion of hydrophobic amino acids in the XTEN sequence. The overall net charge and net charge density is controlled by modifying the content of charged amino acids in the XTEN sequences. In some embodiments, the net charge density of the XTEN of the compositions may be above +0.1 or below −0.1 charges/residue. By "net charge density" of a protein or peptide herein is meant the net charge divided by the total number of amino acids in the protein or proptide. In other embodiments, the net charge density of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge is conferred by incorporation of glutamic acid residues. Accordingly, in one embodiment the invention provides XTEN in which the XTEN sequences contain about 8, 10, 15, 20, 25, or even about 30% glutamic acid. Generally, the glutamic residues would be spaced uniformly across the XTEN sequence. In some cases, the XTEN can contain about 10-80, or about 15-60, or about 20-50 glutamic residues residues per 20 kD of XTEN that can result in an XTEN with charged residues that would have very similar pKa, which can increase the charge homogeneity of the product and sharpen its isoelectric point, enhance the physicochemical properties of the resulting GHXTEN fusion protein for, and hence, simplifying purification procedures.

The XTEN of the compositions of the present invention generally have no or a low content of positively charged amino acids. In some embodiments the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, a growth hormone, plus a chemotherapeutic agent useful in the treatment of animals, wherein the maximum number of molecules of the agent incorporated into the XTEN component is determined by the numbers of lysines or other amino acids with reactive side chains (e.g., cysteine) incorporated into the XTEN.

In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the GHXTEN fusion protein compositions of the present invention carry a net negative charge under physiologic conditions that contribute to the unstructured conformation and reduced binding of the XTEN component to mammalian proteins and tissues.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a GHXTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides GHXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity can attribute to, at least in part, a result of the conformational flexibility of XTEN sequences, i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the GH fusion partner in the GHXTEN compositions.

In one embodiment, the XTEN sequences utilized in the animal fusion proteins can be substantially free of epitopes recognized by T cells. The elimination of such epitopes for the purpose of generating less immunogenic proteins has been disclosed previously; see for example WO 98/52976, WO 02/079232, and WO 00/3317 which are incorporated by reference herein. Assays for T cell epitopes have been described (Stickler, M., et al. (2003) *J Immunol Methods*, 281: 95-108). Of particular interest are peptide sequences that can be oligomerized without generating T cell epitopes. This is achieved by testing direct repeats of these sequences for the presence of T-cell epitopes and for the occurrence of 6 to 15-mer and, in particular, 9-mer sequences, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 45. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that serve as anchor residues during peptide display on MHC, such as M, I, L, V, F. In some embodiments, an XTEN component incorporated into a GHXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In another embodiment, the inventive XTEN sequences, including those incorporated into the animal GHXTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the GHXTEN fusion protein compositions, substantially unable to be bound by mammalian receptors, including those of the immune system. In one embodiment, an XTEN of a GHXTEN fusion protein can have >100 nM $K_d$ binding to a mammalian receptor, or greater than 500 nM $K_d$, or greater than 1 µM $K_d$ towards a mammalian cell surface or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while an XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the GHXTEN has reduced immunogenicity as compared to the corresponding GH that is not fused with an XTEN. In one embodiment, the administration of up to three parenteral doses of a GHXTEN to an animal result in detectable anti-GHXTEN IgG at a serum dilution of 1:100 but not at a dilution of 1:1000. In another embodiment, the administration of up to three parenteral doses of a GHXTEN to an animal result in detectable anti-GH IgG at a serum dilution of 1:100 but not at a dilution of 1:1000. In another embodiment, the administration of up to three parenteral doses of a GHXTEN to an animal result in detectable anti-XTEN IgG at a serum dilution of 1:100 but not at a dilution of 1:1000. In the foregoing embodiments, the animal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the GHXTEN compositions can remain in circulation for an increased period of time.

8. Increased Hydrodynamic Radius

In another aspect, the present invention provides XTEN in which the XTEN polypeptides have a high hydrodynamic radius that confers a corresponding increased Apparent Molecular Weight to the GHXTEN fusion protein incorporating the XTEN. As detailed in Example 37, the linking of XTEN to GH sequences results in GHXTEN compositions that can have increased hydrodynamic radii, increased Apparent Molecular Weight, and increased Apparent Molecular Weight Factor compared to a GH not linked to an XTEN. For example, in therapeutic applications in which prolonged half-life is desired, compositions in which a XTEN with a high hydrodynamic radius is incorporated into a fusion protein comprising one or more GH can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly (ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 37 demonstrate, the addition of increasing lengths of XTEN results in proportional increases in the parameters of hydrodynamic radius, Apparent Molecular Weight, and Apparent Molecular Weight Factor, permitting the tailoring of GHXTEN to desired characteristic cut-off Apparent Molecular Weights or hydrodynamic radii. Accordingly, in certain embodiments, the GHXTEN fusion protein can be configured with an XTEN such that the fusion protein can have a hydrodynamic radius of at least about 5 nm, or at least about 8 nm, or at least about 10 nm, or 12 nm, or at least about 15 nm In the foregoing embodiments, the large hydrodynamic radius conferred by the XTEN in an GHXTEN fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence can be selectively incorporated into a GHXTEN to create a fusion protein that have, under physiologic conditions, an Apparent Molecular Weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN of a chosen length and sequence can be selectively linked to a GH to result in a GHXTEN fusion protein that has, under physiologic conditions, an Apparent Molecular Weight Factor of at least three, alternatively of at least four, alternatively of at least five, alternatively of at least six, alternatively of at least eight, alternatively of at least 10, alternatively of at least 15, or an Apparent Molecular Weight Factor of at least 20 or greater. In another embodiment, the GHXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein.

V). GHXTEN Structural Configurations and Properties

The GH of the animal compositions are not limited to native, full-length polypeptides, but also include recombinant versions as well as biologically and/or pharmacologically active variants or fragments thereof. For example, it will be appreciated that various amino acid deletions, insertions and substitutions can be made in the GH to create variants without departing from the spirit of the invention with respect to the biological activity or pharmacologic properties of the GH. Examples of conservative substitutions for amino acids in polypeptide sequences are shown in Table 4. However, in embodiments of the GHXTEN in which the sequence identity of the GH is less than 100% compared to a specific sequence disclosed herein, the invention contemplates substitution of any of the other 19 natural L-amino acids for a given amino acid residue of the given GH, which may be at any position within the sequence of the GH, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known in the art. In addition, variants can include, for instance, polypeptides wherein one or more amino acid residues are added or deleted at the N- or C-terminus of the full-length native amino acid sequence of a GH that retains some if not all of the biological activity of the native peptide.

TABLE 4

Exemplary conservative amino acid substitutions

| Original Residue | Exemplary Substitutions |
|---|---|
| Ala (A) | val; leu; ile |
| Arg (R) | lys; gin; asn |
| Asn (N) | gin; his; Iys; arg |
| Asp (D) | glu |
| Cys (C) | ser |
| Gln (Q) | asn |
| Glu (E) | asp |
| Gly (G) | pro |
| His (H) | asn: gin: Iys: arg |
| xIle (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr (Y) | trp: phe: thr: ser |
| Val (V) | ile; leu; met; phe; ala; norleucine |

(a) GHXTEN Fusion Protein Configurations

The invention provides GHXTEN fusion protein compositions with the GH and XTEN components linked in specific N- to C-terminus configurations. In some embodiments, one or more GHs are linked to one or more XTENs, either at the N-terminus or at the C-terminus, with or without a spacer, to form a block copolymer, and the sequential arrangement of the GHs and the XTENs in the GHXTEN fusion protein are the same as the configuration known in the block copolymer chemistry. When there is more than one GH, XTEN, or spacer, each of the GH, the XTEN, or the spacer have the same or different sequences, and the GHs and/or XTENs are linked either continuously or alternately (regular or irregular). Thus, in all of the formulae provided herein, when there is more than one GH, XTEN, or spacer, each of the GH, XTEN, and spacer are the same or different. In some embodiments, the GHXTEN is a monomeric fusion protein with a GH linked to one XTEN polypeptide. In other embodiments, the GHXTEN is a monomeric fusion protein with a GH linked to two or more XTEN polypeptides. In still other embodiments, the GHXTEN is a monomeric fusion protein with two or more GH linked to one XTEN polypeptide. In still other embodiments, the GHXTEN is a monomeric fusion protein with two or more GH linked to two or more XTEN polypeptide. Table 5 provides non-limiting examples of configurations that are encompassed by the GHXTEN fusion proteins of the invention; numerous other variations will be apparent to the ordinarily skilled artisan, including the incorporation the spacer and cleavage sequences disclosed herein or known in the art.

TABLE 5

GHXTEN configurations

| Components* | Configuration** |
|---|---|
| Single GH; Single XTEN | GH-XTEN |
|  | XTEN-GH |
| Single GH; Multiple XTEN | XTEN-GH-XTEN |
|  | GH-XTEN-XTEN |

TABLE 5-continued

GHXTEN configurations

| Components* | Configuration** |
|---|---|
|  | XTEN-XTEN-GH |
|  | XTEN-GH-XTEN-XTEN |
|  | XTEN-XTEN-GH-XTEN |
|  | XTEN-XTEN-GH-XTEN |
| Multiple GH, Single XTEN | GH-XTEN-GH |
|  | XTEN-GH-GH |
|  | GH-GH-XTEN |
|  | GH-XTEN-GH-GH |
| Multiple GH; Multiple XTEN | GH-XTEN-GH-XTEN |
|  | XTEN-GH-XTEN-GH |
|  | XTEN-XTEN-GH-XTEN-GH |
|  | XTEN-XTEN-GH-XTEN |
|  | GH-XTEN-XTEN-GH |
|  | GH-GH-XTEN-XTEN |
|  | GH-GH-XTEN-XTEN-GH |
|  | GH-XTEN-GH-XTEN-GH |

*Characterized as single for 1 component or multiple for 2 or more of that component
**Reflects N- to C-terminus configuration of the growth factor and XTEN components The invention contemplates GHXTEN fusion protein compositions comprising, but not limited to single or multiple GH selected from Table 1 (or fragments or sequence variants thereof), single or multiple XTEN selected from Table 3 (or sequence variants thereof) that are in a configuration shown in Table 5. Generally, the resulting GHXTEN retains at least a portion of the biological activity of the corresponding GH not linked to the XTEN. In other embodiments, the GH component either becomes biologically active or has an increase in activity upon its release from the XTEN by cleavage of an optional cleavage sequence incorporated within spacer sequences into the GHXTEN, described more fully below.

In one embodiment of the GHXTEN composition, the invention provides a fusion protein of formula I:

$$(XTEN)_x\text{-}GH\text{-}(XTEN)_y \qquad I$$

wherein independently for each occurrence, GH is a growth hormone; x is either 0 or 1 and y is either 0 or 1 wherein x+y≥1; and XTEN is an extended recombinant polypeptide.

In another embodiment of the GHXTEN composition, the invention provides a fusion protein of formula II:

$$(XTEN)_x\text{-}(GH)\text{-}(S)_y\text{-}(XTEN)_y \qquad II$$

wherein independently for each occurrence, GH is a growth hormone a; S is a spacer sequence having between 1 to about 50 amino acid residues that can optionally include a cleavage sequence; x is either 0 or 1 and y is either 0 or 1 wherein x+y≥1; and XTEN is an extended recombinant polypeptide.

In another embodiment, the invention provides an isolated fusion protein, wherein the fusion protein is of formula III:

$$(GH)\text{-}(S)_x\text{-}(XTEN)\text{-}(S)_y\text{-}(GH)\text{-}(S)_z\text{-}(XTEN)_z \qquad III$$

wherein independently for each occurrence, GH is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion protein, wherein the fusion protein is of formula IV:

$$(XTEN)_x\text{-}(S)_y\text{-}(GH)\text{-}(S)_z\text{-}(XTEN)\text{-}(GH) \qquad IV$$

wherein independently for each occurrence, GH is a growth hormone; S is a spacer sequence having between 1 to about 50 amino acid residues that can optionally include a cleavage sequence; x is either 0 or 1; y is either 0 or 1; z is either 0 or 1; and XTEN is an extended recombinant polypeptide.

In another embodiment, the invention provides an isolated fusion growth hormone, wherein the fusion protein is of formula V:

    V wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VI:

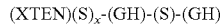    VI wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VII:

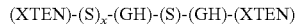    VII wherein independently for each occurrence, GH is a growth hormone; S is a spacer sequence having between 1 to about 50 amino acid residues that can optionally include a cleavage sequence; x is either 0 or 1; y is either 0 or 1; and XTEN is an extended recombinant polypeptide.

In another embodiment, the invention provides an isolated fusion protein, wherein the fusion protein is of formula VIII:

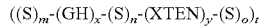    VIII wherein t is an integer that is greater than 0 (1, 2, 3, etc.); independently each of m, n, o, x, and y is an integer (0, 1, 2, 3, etc.), GH is a growth hormone; S is an spacer, optionally comprising a cleavage site; and XTEN is an extended recombinant polypeptide, with the proviso that: (1) x+y>1, (2) when t=1, x>0 and y>0, (3) when there is more than one GH, S, or XTEN, each GH, XTEN, or S are the same or are independently different; and (4) when t>1, each m, n, o, x, or y within each subunit are the same or are independently different.

In some embodiments, administration of a physiologically effective amount of a fusion protein of one one of formulae I-VIII to an animal in need thereof results in a gain in time of at least two-fold, or at least three-fold, or at least four-fold, or at least five-fold, or at least 10-fold, or at least 20-fold, or at least 40-fold, or at least 100-fold or more spent within a therapeutic window for the fusion protein compared to the corresponding GH not linked to the XTEN of and administered at a comparable amount administered to an animal. In other embodiments, administration of a physiologically effective dose of a fusion protein of one of formulae I-VIII to an animal in need thereof can result in a gain in time between consecutive doses necessary to maintain a physiologically effective dose regimen of at least 48 h, or at least 72 h, or at least about 96 h, or at least about 120 h, or at least about 7 days, or at least about 14 days, or at least about 21 days between consecutive doses compared to a GH not linked to XTEN and administered at a comparable dose.

Any spacer sequence group optionally is introduced to a subject fusion proteins is encompassed by the invention. The spacer is provided to enhance expression of the fusion protein from a host cell or to decrease steric hindrance such that the GH component may assume its desired tertiary structure and/or interact appropriately with its target receptor. For spacers and methods of identifying desirable spacers, see, for example, George, et al. (2003) Protein Engineering 15:871-879, which are incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) and proline (P). In some cases, the spacer can be polyglycines or polyalanines, or is predominately a mixture of combinations of glycine and alanine residues. The spacer polypeptide exclusive of a cleavage sequence is largely to substantially devoid of secondary structure; e.g., less than about 10%, or less than about 5% as determined by the Chou-Fasman and/or GOR algorithms. In one embodiment, one or both spacer sequences in a GHXTEN fusion protein composition each further contains a cleavage sequence, which are identical or different, wherein the cleavage sequence may be acted on by a protease to release the GH from the fusion protein.

In some embodiments, the incorporation of the cleavage sequence into the GHXTEN is designed to permit release of a GH that becomes active or more active upon its release from the XTEN. The cleavage sequences are located sufficiently close to the GH sequences, generally within 18, or within 12, or within 6, or within 2 amino acids of the GH sequence terminus, such that any remaining residues attached to the GH after cleavage do not appreciably interfere with the activity (e.g., such as binding to a receptor) of the GH, yet provide sufficient access to the protease to be able to effect cleavage of the cleavage sequence. In some embodiments, the cleavage site is a sequence that can be cleaved by a protease endogenous to the animal such that the GHXTEN can be cleaved after administration to an animal. In such cases, the GHXTEN can serve as a prodrug or a circulating depot for the GH. Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences and cut sites within the sequences are presented in Table 6, as well as sequence variants thereof. For example, thrombin (activated clotting factor II) acts on the sequence LTPRSLLV (SEQ ID NO: 82) (Rawlings N. D., et al. (2008) Nucleic Acids Res., 36: D320), which would be cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an on-going process in animals, by incorporation of the LTPRSLLV sequence (SEQ ID NO: 83) into the GHXTEN between the GH and the XTEN, the XTEN domain would be removed from the adjoining GH concurrent with activation of either the extrinsic or intrinsic coagulation pathways when coagulation is required physiologically, thereby releasing GH over time. Similarly, incorporation of other sequences into GHXTEN that are acted upon by endogenous proteases would provide for sustained release of GH that, in certain embodiments, provide a higher degree of activity for the GH from the "prodrug" form of the GHXTEN.

In some embodiments, only the two or three amino acids flanking both sides of the cut site (four to six amino acids total) are incorporated into the cleavage sequence. In other embodiments, the known cleavage sequence have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the GH from the XTEN. Exemplary substitutions are shown in Table 6.

sequences that retain at least about 40%, or about 50%, or about 55%, or about 60%, or about 70%, or about 80%, or about 90%, or about 95% or more activity compared to the corresponding native GH sequence would be considered suitable for inclusion in the animal GHXTEN. The GH found to retain a suitable level of activity can be linked to one or more XTEN polypeptides described hereinabove. In one embodiment, a GH found to retain a suitable level of activity can be linked to one or more XTEN polypeptides having at least about 80% sequence identity to a sequence from Table 3, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as com-

TABLE 6

Protease Cleavage Sequences

| Protease Acting Upon Sequence | Exemplary Cleavage Sequence | SEQ ID NO:Minimal Cut Site* | SEQ ID NO: |
|---|---|---|---|
| FXIa | KLTR↓VVGG | 84 KD/FL/T/R↓VA/VE/GT/GV | |
| FXIIa | TMTR↓IVGG | 85 NA | |
| Kallikrein | SPFR↓STGG | 86 -/-/FL/RY↓SR/RT/-/- | |
| FVIIa | LQVR↓IVGG | 87 NA | |
| FIXa | PLGR↓IVGG | 88 -/-/G/R↓-/-/-/- | |
| FXa | IEGR↓TVGG | 89 IA/E/GFP/R↓STI/VFS/-/G | |
| FIIa (thrombin) | LTPR↓SLLV | 90 -/-/PLA/R↓SAG/-/-/- | |
| Elastase-2 | LGPV↓SGVP | 91 -/-/-/VIAT↓-/-/-/- | |
| Granzyme-B | VAGD↓SLEE | 92 V/-/-/D↓-/-/-/- | |
| MMP-12 | GPAG↓LGGA | 93 G/PA/-/G↓L/-/G/- | 94 |
| MMP-13 | GPAG↓LRGA | 95 G/P/-/G↓L/-/GA/- | 96 |
| MMP-17 | APLG↓LRLR | 97 -/PS/-/-↓LQ/-/LT/- | |
| MMP-20 | PALP↓LVAQ | 98 NA | |
| TEV | ENLYFQ↓G | 99 ENLYFQ↓G/S | 100 |
| Enterokinase | DDDK↓IVGG | 101 DDDK↓IVGG | 102 |
| Protease 3C (PreScission ™) | LEVLFQ↓GP | 103 LEVLFQ↓GP | 104 |
| Sortase A | LPKT↓GSES | 105 L/P/KEAD/T↓G/-/EKS/S | 106 |

↓ indicates cleavage site
NA: not applicable
*the listing of multiple amino acids before, between, or after a slash indicate alternative amino acids that can be substituted at the position; "-" indicates that any amino acid may be substituted for the corresponding amino acid indicated in the middle column In one embodiment, a GH incorporated into a GHXTEN fusion protein have a sequence that exhibits in the GH protein at least about 80% sequence identity to a sequence from Table 1, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or about 100% sequence identity as compared with a sequence from Table 1. The GH of the foregoing embodiment can be evaluated for activity using assays or measured or determined parameters as described herein, and those pared with a sequence of Table 3, resulting in a chimeric fusion protein.

Non-limiting examples of sequences of fusion proteins containing a single GH linked to a single XTEN are presented in Table 35. In one embodiment, a GHXTEN composition would comprise a fusion protein having at least about 80% sequence identity to a GHXTEN from Table 35, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a GHXTEN from Table 35. Non-limiting examples of sequences of fusion proteins containing two molecules of XTEN linked to one or more GH are presented in Table 36, but the invention also contemplates substitution of other GH with sequences exhibiting at least about 90% sequence identity to a sequence selected from Table 1 linked to one or two XTEN, which may be the same or different, exhibiting at least about 90% sequence identity selected from Table 3. In the foregoing fusion proteins hereinabove described in this paragraph, the GHXTEN fusion protein can further comprise a cleavage sequence from Table 6; the cleavage sequence being located between the GH and the XTEN or between adjacent GH (if more than one GH is included in the GHXTEN). In some cases, the GHXTEN comprising the cleavage sequences will also have one or more spacer sequence amino acids between the GH and the cleavage sequence or the XTEN and the cleavage sequence to facilitate access of the protease; the spacer amino acids comprising any natural amino acid, including glycine and alanine as preferred amino acids. Non-limiting examples of GHXTEN comprising GH, XTEN, cleavage sequence(s) and spacer amino acids are presented in Table 37. However, the invention also contemplates substitution of any of the GH sequences of Table 1 for a GH sequence of Table 37, substitution of any XTEN sequence of Table 3 for an XTEN sequence of Table 37, and substitution of any cleavage sequence of Table 6 for a cleavage sequence of Table 37.

(b) Pharmacokinetic Properties of GHXTEN

The invention provides GHXTEN fusion proteins with enhanced pharmacokinetics compared to the GH not linked to XTEN that, when used at the dose determined for the composition by the methods described herein, can achieve a circulating concentration resulting in a pharmacologic effect, yet stay within the safety range for biologically active component of the composition for an extended period of time compared to a comparable dose of the GH not linked to XTEN. In such cases, the GHXTEN remains within the therapeutic window for the fusion protein composition for the extended period of time. As used herein, a "comparable dose" means a dose with an equivalent moles/kg for the active GH pharmacophore that is administered to an animal in a comparable fashion. It will be understood in the art that a "comparable dosage" of GHXTEN fusion protein can represent a greater weight of agent but would have essentially the same mole-equivalents of GH in the dose of the fusion protein and/or would have the same approximate molar concentration relative to the GH.

The pharmacokinetic properties of a GH that can be enhanced by linking a given XTEN to the GH include terminal half-life, area under the curve (AUC), $C_{max}$ volume of distribution, and bioavailability providing enhanced utility in the treatment of animals. The GH of the GHXTEN compositions can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 1, linked to one or more XTEN that exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Table 3.

As described more fully in the Examples pertaining to pharmacokinetic characteristics of fusion proteins comprising XTEN, it was observed that increasing the length of the XTEN sequence confers a disproportionate increase in the terminal half-life of a fusion protein comprising the XTEN. Accordingly, the invention provides GHXTEN fusion proteins comprising XTEN wherein the XTEN is selected to provide a targeted half-life for the GHXTEN composition administered to an animal. In some embodiments, the invention provides monomeric fusion proteins comprising XTEN wherein the XTEN is selected to confer an increase in the terminal half-life for the GHXTEN administered to an animal, compared to the corresponding GH not linked to the fusion protein and administered at a comparable dose, of at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold, or at least a 80-fold, or at least a 100-fold or greater an increase in terminal half-life compared to the GH not linked to the fusion protein. Exogenously administered human growth hormone has been reported to have a terminal half-life in humans of less than 15 minutes (Hindmarch, P. C., et al., Clinical Endocrinology (2008) 30(4): 443-450), whereas various GHXTEN compositions disclosed herein that have been experimentally administered to various animals species, as described in the Examples, have resulted in terminal half-life values of several hours. In one embodiment, the invention provides GHXTEN that exhibits an increase of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% increase in AUC compared to the corresponding GH not linked to the XTENT and administered to an animal at a comparable dose. The pharmacokinetic parameters of a GHXTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

The invention further provides GHXTEN comprising a first and a second GH molecule, optionally separated by a spacer sequence that may further comprise a cleavage sequence, or separated by a second XTEN sequence. In one embodiment, the GH has less activity when linked to the fusion protein compared to a corresponding GH not linked to the fusion protein. In such case, the GHXTEN is designed such that upon administration to an animal, the GH component is gradually released by cleavage of the cleavage sequence(s), whereupon it regains activity or the ability to bind to its target receptor or ligand. Accordingly, the GHXTEN of the foregoing serves as a prodrug or a circulating depot, resulting in a longer terminal half-life compared to GH not linked to the fusion protein.

(c) Pharmacology and Pharmaceutical Properties of GHXTEN

The present invention provides GHXTEN compositions comprising GH covalently linked to XTEN that can have enhanced properties compared to GH not linked to XTEN, as well as methods to enhance the therapeutic and/or biologic activity or effect of the respective two GH components of the compositions. In addition, the invention provides GHXTEN compositions with enhanced properties compared to those fusion proteins containing immunoglobulin polypeptide partners, polypeptides of shorter length and/or polypeptide partners with repetitive sequences. In addition, GHXTEN fusion proteins provide significant advantages over chemical conjugates, such as pegylated constructs, notably the fact that recombinant GHXTEN fusion proteins can be made in bacterial cell expression systems, which can reduce time and cost at both the research and development and manufacturing stages of a product, as well as result in a more homogeneous, defined product with less toxicity for both the product and metabolites of the GHXTEN compared to pegylated conjugates.

As therapeutic agents, the GHXTEN possesses a number of advantages over therapeutics not comprising XTEN including one or more of the following non-limiting exemplary enhance properties: increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages capable of maintain blood levels within the therapeutic window for the GH, a "tailored" rate of absorption, enhanced lyophilization stability, enhanced serum/plasma stability, increased terminal half-life, increased solubility in blood stream, decreased binding by neutralizing antibodies, decreased receptor-mediated clearance, reduced side effects, retention of receptor/ligand binding affinity or receptor/ligand activation, stability to degradation, stability to freeze-thaw, stability to proteases, stability to ubiquitination, ease of administration, compatibility with other pharmaceutical excipients or carriers, persistence in the animal, increased stability in storage (e.g., increased shelf-life), reduced toxicity in an organism or environment and the like. The net effect of the enhanced properties is that the GHXTEN results in enhanced physiologic and/or biologic effect or improved compliance and/or ease of use when administered to an animal.

Specific assays and methods for measuring the physical and structural properties of expressed proteins are known in the art, including methods for determining properties such as protein aggregation, solubility, secondary and tertiary structure, melting properties, contamination and water content, etc. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

In a particular feature of the invention, XTEN as a fusion partner increases the solubility of the GH payload, particularly in the expression of GH, which is typically expressed as insoluble inclusion bodies in transformed host cells, such as *E. coli* (see, e.g., Singh, S. M., et al. (2005) *J Biosci Bioeng*, 99: 303; Patra, A. K., et al. (2000) *Protein Expr Purif,* 18: 182). Accordingly, where enhancement of the pharmaceutical or physicochemical properties of the GH is desirable, such as the degree of aqueous solubility or stability, the length and/or the motif family composition of the first and the second XTEN sequences of the first and the second fusion protein may each be selected to confer a different degree of solubility and/or stability on the respective fusion proteins such that the overall pharmaceutical properties of the GHXTEN composition are enhanced. The GHXTEN fusion proteins can be constructed and assayed, using methods described herein, to confirm the physicochemical properties and the XTEN adjusted, as needed, to result in the desired properties. In one embodiment, the XTEN sequence of the GHXTEN is selected such that the fusion protein has an aqueous solubility that is within at least about 25% greater compared to a GH not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding GH not linked to the fusion protein.

The invention provides methods to produce and recover expressed GHXTEN from a host cell with enhanced solubility and ease of recovery compared to GH not linked to XTEN. In some embodiments, the method includes the steps of transforming a prokaryotic host cell (e.g, *E. coli*) with a polynucleotide encoding a GHXTEN with one or more XTEN components of cumulative sequence length greater than about 800, or greater than about 900, or greater than about 1000, or greater than about 1100 amino acid residues, expressing the GHXTEN fusion protein in the host cell, lysing the host cell to recover cytoplasmic contents, and acidifying the host cell cytoplasmic contents wherein the GH can remain in soluble form while the majority of host cell proteins are precipitated to insoluble form. In one embodiment of the foregoing, the post-expression crude host cell lysates can be acidified to a pH of less than about 5.0, or to a pH of less than about 4.7, or to a pH of less than about 4.5, or to a pH of less than about 4.2 and greater than about 50%, or about 60%, or about 70%, or about 80% or more of the expressed GH can be recovered in soluble form. In a feature of the foregoing embodiment, enriched GHXTEN can be separated from precipitated from host cell protein contaminants by centrifugation of the acidified lysate, a reflection of the increased solubility imparted to the GH by fusion to the XTEN carrier. In the embodiments hereinabove described in this paragraph, the XTEN of the GHXTEN fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity to one or more XTEN selected from Table 3 and the GH can have at least about 80% sequence identity, or about 90%, or about 91%, or about 92%, or about 93%, or about 94%, or about 95%, or about 96%, or about 97%, or about 98%, or about 99%, or 100% sequence identity to a GH selected from Table 1 and the GHXTEN components can be in an N- to C-terminus configuration selected from Table 5.

In one embodiment, the invention provides GHXTEN compositions and methods to produce the compositions that can maintain the GH component within a therapeutic window for a greater period of time compared to comparable dosages of the corresponding GH not linked to XTEN. It will be understood in the art that a "comparable dosage" of GHXTEN fusion protein would represent a greater weight of agent but would have the same approximate mole-equivalents of GH in the dose of the fusion protein and/or would have the same approximate molar concentration relative to the GH. The method to produce the compositions that can maintain the GH component within a therapeutic window includes the steps of selecting the XTEN appropriate for conjugation to a GH to provide the desired pharmacokinetic properties in view of a given dose and dose regiment, followed by assays to verify the pharmacokinetic properties, the activity of the GHXTEN fusion protein, and the safety of the administered composition. By the methods, GHXTEN can be produced that enables increased efficacy of the administered composition by maintaining the circulating concentrations of the GH within the therapeutic window for an enhanced period of time. As used herein, "therapeutic window" means that the amount of drug or biologic as a blood or plasma concentration range, which provides efficacy or a desired pharmacologic effect over time for the disease or condition without unacceptable toxicity, i.e. the range of the circulating blood concentrations between the minimal amount to achieve any positive therapeutic effect and the maximum amount which results in a response that is the response immediately before toxicity to the animal (at a higher dose or concentration). Additionally, therapeutic window generally encompasses an aspect of time; the maximum and minimum concentration that results in a desired pharmacologic effect over time that does not result in unacceptable toxicity or adverse events. A dosed composition that stays within the therapeutic window for the animal could also be said to be within the "safety range."

The characteristics of GHXTEN compositions of the invention, including functional characteristics or biologic and pharmacologic activity and parameters that result, are determined by any suitable screening assay known in the art for measuring the desired characteristic. The invention provides methods to assay the GHXTEN fusion proteins of differing composition or configuration in order to provide GHXTEN with the desired degree of biologic and/or therapeutic activity, as well as safety profile. Specific in vivo and ex vivo biological assays are used to assess the activity of each configured GHXTEN and/or GH component to be incorporated into GHXTEN, including but not limited to the assays of the Examples, those assays of Table 34, as well as the following assays or other such assays known in the art for assaying the properties and effects of GH. Assays can be conducted that allow determination of binding characteristics of the GHXTEN for GH receptors or a ligand, including binding constant ($K_d$), $EC_{50}$ values, as well as their half-life of dissociation of the ligand-receptor complex ($T_{1/2}$). Binding affinity can be measured, for example, by a competition-type binding assay that detects changes in the ability to specifically bind to a receptor or ligand (see, e.g., Examples). Additionally, techniques such as flow cytometry or surface plasmon resonance can be used to detect binding events. The assays may comprise soluble receptor molecules, or may determine the binding to cell-expressed receptors. Such assays may include cell-based assays, including assays for proliferation, cell death, apoptosis and cell migration. Other possible assays may determine receptor binding of expressed polypeptides, wherein the assay may comprise soluble receptor molecules, or may determine the binding to cell-expressed receptors. The binding affinity of a GHXTEN for the target receptors or ligands of the corresponding GH can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. In addition, GH sequence variants (assayed as single components or as GHXTEN fusion proteins) can be compared to the native GH using a competitive ELISA binding assay to determine whether they have the same binding specificity and affinity as the native GH, or some fraction thereof such that they are suitable for inclusion in GHXTEN. Functional assays can include the increase of IGF-1 secretion and/or generation within target cells as a result of exposure to GHXTEN, and/or the resulting stimulatory effects of IGF-1 on osteoblast and chondrocyte activity to promote bone growth; all are suitable parameters to assess the activity of GH for inclusion in the GHXTEN fusion protein or the resulting GHXTEN. In addition, growth hormone is known to play a role in somatic growth through its effects on the metabolism of proteins, carbohydrates and lipids, as well as the stimulation of the production of blood cells in vitro (Derfalvi et al., 1998; Merchav et al; 1988), to increase numbers of erythrocytes and hemoglobin content in blood (Valerio et al., 1997; Vihervuori et al., 1996), as wells as the enhancement of proliferation of and Ig production in plasma cell lines (Kimata and Yoshida, 1994), the stimulation of $CD8^+$ cell counts and, to a lesser extent $CD4^+$ cell counts (Geffner, 1997). In addition, bGH is known to increase lactation and milk yield (Hayashi A A, et al., J Dairy Sci. (2009) 92(5):1889-99; Shingu H, et al., J Anim Sci. (2009) 87(4): 1247-53). Parameters that can be measured chronically include velocity of growth, physical maturation, comparative bone rate of growth, glucose levels in response to insulin challenge, lipolysis, milk yield and duration of lactation. All of the foregoing can be used to assess the activity of GH components to be incorporated into GHXTEN and the resulting GHXTEN.

Dose optimization is important for all drugs, especially for those with a narrow therapeutic window. For example, a standardized single dose of GH for all animals may not always be effective. A consideration of these factors is well within the purview of the ordinarily skilled clinician for the purpose of determining the physiologically or pharmacologically effective amount of the GHXTEN, versus that amount that would result in unacceptable toxicity and place it outside of the safety range, or insufficient potency such that clinical improvement is not achieved.

In many cases, the therapeutic window for GH in animals of different ages or degree of disease have been established and are available in published literature or are stated on the drug label for approved products containing the GH. In other cases, the therapeutic window can be established for new compositions, including those GHXTEN of the disclosure. The methods for establishing the therapeutic window for a given composition are known to those of skill in the art (see, e.g., Goodman & Gilman's The Pharmacological Basis of Therapeutics, $11^{th}$ Edition, McGraw-Hill (2005)). For example, by using dose-escalation studies in animals to determine efficacy or a desirable pharmacologic effect, appearance of adverse events, and determination of circulating blood levels, the therapeutic window for a given animal or population of animals can be determined for a given drug or biologic, or combinations of biologics or drugs. The dose escalation studies can evaluate the activity of a GHXTEN through metabolic studies in an animal or group of animals that monitor physiological or economic parameters, as known in the art or as described herein for growth hormone, together with observations and/or measured parameters to determine the no effect dose, adverse events, maximum tolerated dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and above which toxicity occurs, thereby establishing the therapeutic window for the dosed therapeutic. Blood concentrations of the fusion protein (or as measured by the GH component) above the maximum would be considered outside the therapeutic window or safety range. Thus, by the foregoing methods, a $C_{min}$ blood level would be established, below which the GHXTEN fusion protein would not have the desired pharmacologic effect, and a $C_{max}$ blood level would be established that would represent the highest circulating concentration before reaching a concentration that would elicit unacceptable side effects, toxicity or adverse events, placing it outside the safety range for the GHXTEN. With such concentrations established, the frequency of dosing and the dosage can be further refined by measurement of the $C_{max}$ and $C_{min}$ to provide the appropriate dose and dose frequency to keep the fusion protein(s) within the therapeutic window. One of skill in the art can, by the means disclosed herein or by other methods known in the art, confirm that the administered GHXTEN remains in the therapeutic window for the desired interval or requires adjustment in dose or length or sequence of XTEN. Further, the determination of the appropriate dose and dose frequency to keep the GHXTEN within the therapeutic window establishes the physiologically effective dose regimen; the schedule for administration of multiple consecutive doses using a physiologically effective dose of the fusion protein to an animal in need thereof resulting in consecutive $C_{max}$ peaks and/or $C_{min}$ troughs that remain within the therapeutic window and results in an improvement in at least one measured parameter relevant for growth hormone. In some cases, the GHXTEN administered at an appropriate dose to an animal results in blood concentrations of the GHXTEN fusion protein that remains within the therapeutic window for a period at least about two-fold longer compared to the corresponding GH not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer or greater compared to the corresponding GH not linked to XTEN and administered at a comparable dose. As used herein, an "appropriate dose" means a dose of a drug or biologic that, when administered to an animal, would result in a desirable therapeutic or pharmacologic effect and a blood concentration within the therapeutic window.

In one embodiment, the GHXTEN administered at a physiologically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the fusion protein and administered at a comparable dose regimen to an animal. In another embodiment, the GHXTEN administered at a physiologically effective dose regimen results in a comparable improvement in one, or two, or three or more measured parameter using less frequent dosing or a lower total dosage in moles of the fusion protein of the pharmaceutical composition compared to the corresponding biologically active protein component(s) not linked to the fusion protein and administered to an animal using a physiologically effective dose regimen for the GH. The measured parameters include any of the clinical, biochemical, or physiological parameters disclosed herein, or others known in the art for assessing animals treated with growth hormone.

The invention provides isolated GHXTEN in which the binding affinity for GH target receptors or ligands by the GHXTEN can be at least about 10%, or at least about 20%, or at least about 30%, or at least about 40%, or at least about 50%, or at least about 60%, or at least about 70%, or at least about 80%, or at least about 90%, or at least about 95%, or at least about 99%, or at least about 100% or more of the affinity of a native GH not bound to XTEN for the target receptor or ligand. In some cases, the binding affinity $K_d$ between the animal GHXTEN and a native receptor or ligand of the GHXTEN is at least about $10^{-4}$ M, alternatively at least about $10^{-5}$ M, alternatively at least about $10^{-6}$ M, or at least about $10^{-7}$ M, or at least about $10^{-8}$ M, or at least about $10^{-9}$ M of the affinity between the GHXTEN and a native receptor or ligand.

In other embodiments, the invention provides isolated GHXTEN fusion proteins specifically designed to have reduced binding affinity to the GH receptor. In one embodiments, such as fusion proteins comprising a first XTEN fused to the N-terminus of the GH and a second XTEN fused to the C-terminus of the GH. In one embodiment, the GXTEN exhibits at least about 80%, or at least about 90%, or at least about 95%, or at least about 96%, or at least about 97%, or at least about 98%, or at least about 98% sequence identity compared to GHXTEN fusion proteins selected from AE912-bGH-AE144, AE912-bGH-AF144, AE912-bGH-AE288, AM923-bGH-AE144, AM923-bGH-AF144, AM923-bGH-AE288, and the sequences of Tables 36-37.

In some embodiments, the GHXTEN fusion proteins of the invention retain at least about 0.05%, or about 0.1%, or about 1%, or about 10%, or about 20%, or about 30%, or about 40%, or about 50%, or about 60%, or about 70%, or about 80%, or about 90%, or about 95%, or about 98%, or about 99% percent of the biological activity of the corresponding GH not linked to the fusion protein with regard to an in vitro biologic activity or pharmacologic effect known or associated with the use of the native GH. Non-limiting examples of activities or pharmacologic effects that can be assayed to assess the retained activity of the GHXTEN fusion proteins include signal transduction markers in cells with GH receptors, elicited IGF-1 concentrations, elicited IGFBP3 concentrations, changes in growth velocity, body mass, total body fat, muscle mass, bone growth, lactation, duration of lactation, hoof growth, lipolysis, and efficiency of converting feed to meat or milk, measurement of division and multiplication rates of chondrocytes, and/or changes in bone density and/or bone growth. In some embodiments, the activity of the GH component is manifested by the intact GHXTEN fusion protein, while in other cases the activity of the GH component would be primarily manifested upon cleavage and release of the GH from the fusion protein by action of a protease that acts on a cleavage sequence incorporated into the GHXTEN fusion protein. In the foregoing, the GHXTEN is designed to reduce the binding affinity of the GH component for the receptor or ligand when linked to the XTEN but have restored or increased affinity when released from XTEN through the cleavage of cleavage sequence(s) incorporated into the GHXTEN sequence, as described more fully above.

In other cases, the GHXTEN can be designed to reduce the binding affinity of the GH component to the GH receptor to increase the terminal half-life of GHXTEN administered to an animal by reducing receptor-mediated clearance; e.g., by adding an XTEN to the C-terminus of the GH component of the fusion protein. In other cases, the GHXTEN are designed to reduce the binding affinity of the GH component to the GH receptor to reduce toxicity or side effects due to the administered composition.

Figure 3:
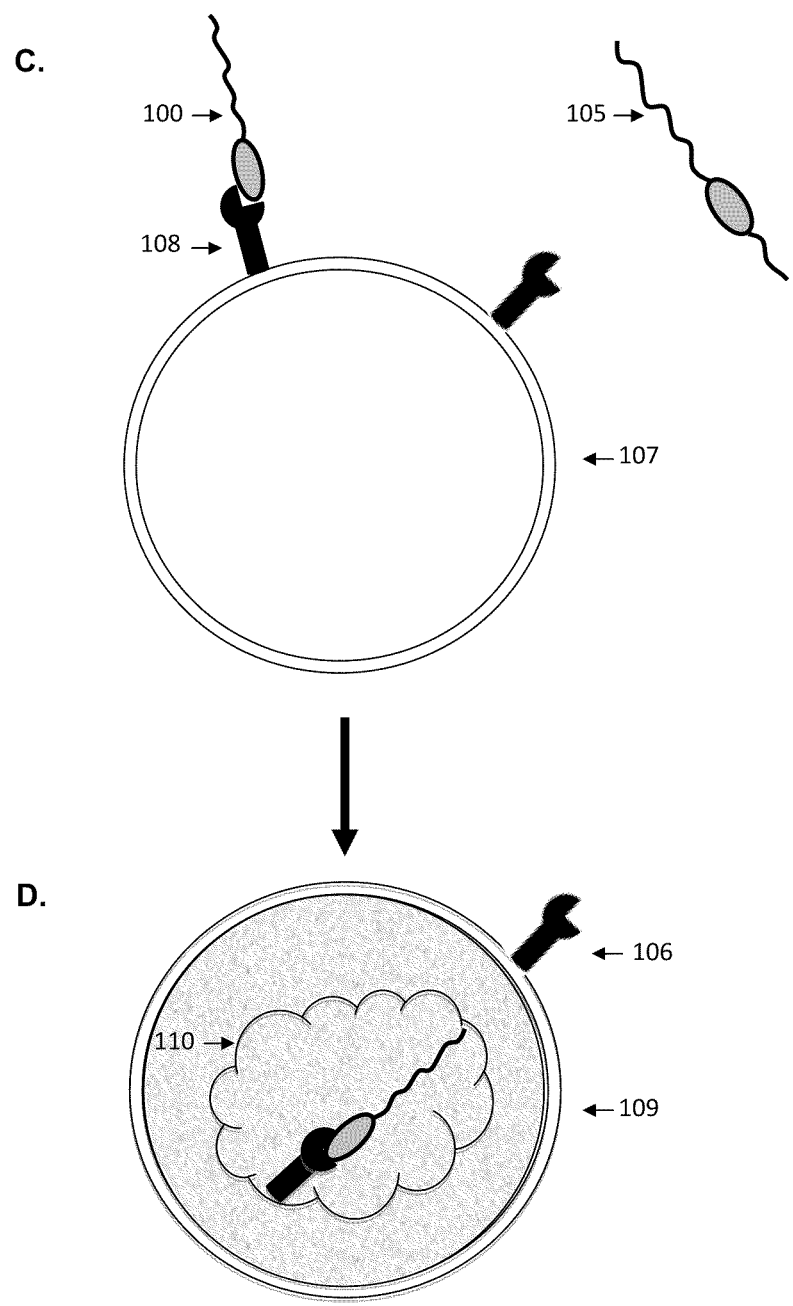
FIGS. 3A-D show schematic illustrations of two exemplary monomeric GHXTEN and the ability of the monomeric fusion proteins to bind to a target receptor on a cell surface, with subsequent cell signaling.

Accordingly, the invention provides a method for increasing the terminal half-life of a GHXTEN by producing a single-chain fusion protein construct with a specific N- to C-terminus configuration of the components comprising at least a first GH and a first and a second XTEN, wherein the fusion protein in a first N- to C-terminus configuration of the GH and XTEN components has reduced receptor-mediated clearance (RMC) and a corresponding increase in terminal half-life compared to a GHXTEN in a second N- to C-terminus configuration. In one embodiment of the foregoing, the GHXTEN is configured, N- to C-terminus as XTEN-GH- XTEN, which has reduced receptor binding compared to a GHXTEN configures, N- to C-terminus XTEN-GH. In another embodiment of the foregoing, the GHXTEN is configured GH-XTEN. In the foregoing embodiments, the two XTEN molecules can be identical or they can be of a different sequence composition or length. Non-limiting examples of the foregoing embodiment with two XTEN linked to a single GH include the constructs AE912-bGH-AE144, AE912-bGH-AE288, AE864-bGH-AE144, AM923-bGH-AE144, and AM923-bGH-AE288. The invention contemplates other such constructs in which a GH from Table 1 and XTEN from Table 3 are substituted for the respective components of the foregoing examples, and are produced, for example, in a configuration from Table 5 such that the construct has reduced receptor mediated clearance compared to an alternative configuration of the respective components. In some embodiments, the foregoing method for increasing the terminal half-life provides configured GHXTEN that can result in an increase in the terminal half-life of at least about 30%, or about 50%, or about 75%, or about 100%, or about 150%, or about 200%, or about 300%, or about 400% or more compared to the half-life of a GHXTEN in a second configuration where receptor binding is not reduced. The invention takes advantage of the fact that certain ligands wherein reduced binding affinity to a receptor, either as a result of a decreased on-rate or an increased off-rate, may be effected by the obstruction of either the N- or C-terminus (as shown in FIG. 3), and using that terminus as the linkage to another polypeptide of the composition, whether another molecule of a GH, an XTEN, or a spacer sequence results in the reduced binding affinity. The choice of the particular configuration of the GHXTEN fusion protein reduces the degree of binding affinity to the receptor such that a reduced rate of receptor-mediated clearance is achieved. Generally, activation of the receptor is coupled to RMC such that binding of a polypeptide to its receptor without activation does not lead to RMC, while activation of the receptor leads to RMC. However, in some cases, particularly where the ligand has an increased off rate, the ligand may nevertheless be able to bind sufficiently to initiate cell signaling without triggering receptor mediated clearance, with the net result that the GHXTEN remains bioavailable. In such cases, the configured GHXTEN has an increased half-life compared to those configurations that lead to a higher degree of RMC.

In cases where a reduction in binding affinity to the growth hormone receptor is desired in order to reduce receptor-mediated clearance but retention of at least a portion of the biological activity is also desired, sufficient binding affinity to obtain the desired receptor activation must nevertheless be maintained e.g., by initiation of signal transduction. Thus, in one embodiment, the invention provides a GHXTEN configured such that the binding affinity of the GHXTEN for a target receptor is in the range of about 0.01%-40%, or about 0.01%-30%, or about 0.01%-20% of the binding affinity compared to a corresponding GHXTEN in a configuration wherein the binding affinity is not reduced. The binding affinity of the configured BXTEN is thus preferably reduced by at least about 60%, or at least about 70%, or at least about 80%, or at least about 90%, or at least about 95%, or at least about 99%, or at least about 99.99% as compared to the binding affinity of a corresponding GHXTEN in a configuration wherein the binding affinity of the GH component to the target receptor is not reduced or compared to the GH not linked to the fusion protein, determined under comparable conditions. Expressed differently, the GH component of the configured GHXTEN has a binding affinity that is as small as about 0.01%, or at least about 0.1%, or at least about 1%, or at least about 2%, or at least about 3%, or at least about 4%, or at least about 5%, or at least about 10%, or at least about 20%, or at least about 30%, or at least 40% of that of the corresponding GH component of a GHXTEN in a configuration wherein the binding affinity of the GH component is not reduced. In the foregoing embodiments, the binding affinity of the configured GHXTEN for the target receptor are "substantially reduced" compared to a corresponding native GH or a GHXTEN with a configuration in which the binding affinity of the corresponding GH component is not reduced. Accordingly, the present invention provides compositions and methods to produce compositions with reduced RMC by configuring the GHXTEN, examples of which are provided above, so as to be able to bind and activate a sufficient number of receptors to obtain a desired in vivo biological response yet avoid activation of more receptors than is required for obtaining such response. The increased half-life permits higher dosages and reduced frequency of dosing compared to GH not linked to XTEN or compared to GHXTEN configurations wherein the GH component retains sufficient biological or pharmacological activity to result in a composition with clinical efficacy maintained despite reduced dosing frequency.

VI). Uses of the Compositions of the Present Invention

In another aspect, the invention provides a method for achieving a beneficial effect in an animal mediated by GH. The present invention addresses disadvantages and/or limitations of GH that have a relatively short terminal half-life and/or a narrow therapeutic window.

Most processes involved in growth of the body are regulated by multiple peptides and hormones, and such peptides and hormones, as well as analogues thereof, have found utility in the treatment of growth hormone-related diseases, disorders and conditions. However, the use of commercially-available growth hormones, has met with less than optimal success in the treatment of animals. In particular, dose optimization and frequency of dosing is important for peptide and hormone biologics used in the treatment of animals, for both physiologic and economic reasons. The fact that growth hormone has a short half-life, necessitates frequent dosing in order to achieve a benefit, which results in difficulties in the management of such practices or a poor economic outcome.

In one embodiment, the invention provides a method for achieving a beneficial effect in an animal comprising the step of administering to the animal a physiologically-effective amount of a GHXTEN wherein said administration results in the improvement of one or more biochemical or physiological parameters or clinical endpoints associated with a growth hormone. The effective amount produces a beneficial effect in helping to treat (e.g., cure or reduce the severity) or improve a physiologic condition or result in an economic benefit. In some cases, the method for achieving a beneficial effect includes administering a physiologically effective amount of a GHXTEN fusion protein composition to treat an animal that results in the improvement or enhancement of at least one parameter selected from IGF-1 and IGFBP3 concentrations, changes in growth velocity, body mass, total body fat, muscle mass, bone growth, lactation, duration of lactation, hoof growth, lipolysis, and efficiency of converting feed to meat or milk, measurement of division and multiplication rates of chondrocytes, and/or changes in bone density and/or bone growth, wherein the improvement is at least about 5%, or at least about 6%, or at least about 7%, or at least about 8%, or at least about 9%, or at least about 10%, or at least about 15%, or at least about 20% greater compared to a GH not linked to an XTEN and administered to an animal using a comparable amount.

In one embodiment, the invention provides a method of stimulating IGF-1 production in an animal. The method comprises the step of administering physiologically effective amount of GHXTEN to an animal that results in the increased blood levels and/or duration in increased blood levels of IGF-1 compared to an animal receiving a GH not linked to an XTEN and administered at a comparable dose. In some cases, the increase in IGF-1 is at least about 20%, or at least about 30%, or at least about 40%, or at least about 50%, or at least about 75%, or at least about 100%, or at least about 200%, or at least about 300%. In another embodiment, the invention provides a method of stimulating the division and numbers of chrondrocytes. The method comprises the step of administering physiologically effective amount of GHXTEN that results in the increased production of chrondrocytes by at least about 20%, or at least about 30%, or at least about 40%, or at least about 50%, or at least about 75%, or at least about 100%, or at least about 200%, or at least about 300% compared to an animal receiving a GH not linked to an XTEN and administered at a comparable dose. In another embodiment, the invention provides a method comprising the step of administering physiologically effective amount of GHXTEN that results in increased lactation as measured by an increase in milk volume production/day by at least about 5%, or at least about 6%, or at least about 7%, or at least about 8%, or at least about 9%, or at least about 10%, or at least about 15%, or at least about 20% greater compared to a GH not linked to an XTEN and administered to an animal using a comparable amount.

As a result of the enhanced PK parameters of GHXTEN, as described herein, the GH is administered using longer intervals between doses compared to the corresponding GH not linked to XTEN to treat or improve the growth hormone-related parameter, wherein the period between doses is at least three-fold, or at least about four-fold, or at least about five-fold, or at least seven-fold, or at least about 10-fold longer between doses required to achieve an increased or enhanced parameter compared to a GH not linked to XTEN.

The methods of the invention includes administration of consecutive doses of a physiologically effective amount of the GHXTEN for a period of time sufficient to achieve and/or maintain the desired parameter or effect, and such consecutive doses of a physiologically effective amount establishes the physiologically effective dose regimen for the GHXTEN, i.e., the schedule for consecutively administered doses of the fusion protein composition, wherein the doses are given in physiologically effective amounts to result in a sustained beneficial effect on any clinical sign or symptom, aspect, measured parameter or characteristic of a metabolic disease state or condition, including, but not limited to, those described herein. In one embodiment, the method comprises administering a physiologically-effective amount of a pharmaceutical composition comprising a GHXTEN fusion protein composition comprising a GH linked to an XTEN sequence(s) and at least one pharmaceutically acceptable carrier to an animal that results in greater improvement in at least one parameter, physiologic condition, or clinical outcome mediated by the GH component(s) (non-limiting examples of which are described above) compared to the effect mediated by administration of a pharmaceutical composition comprising a GH not linked to XTEN and administered at a comparable dose. In one embodiment, the pharmaceutical composition is administered at a physiologically effective dose. In another embodiment, the pharmaceutical composition is administered using multiple consecutive doses using a physiologically effective dose regimen (as defined herein) for the length of the dosing period. A physiologically effective amount of the GHXTEN varies according to factors such as the age, sex, and weight of the animal, and the ability of the GH portion to elicit a desired response in the animal.

For the inventive methods, longer acting GHXTEN compositions are preferred, so as to improve convenience, to increase the interval between doses and to reduce the amount of drug required to achieve a sustained effect. In one embodiment, a method of treatment comprises administration of a physiologically effective dose of a GHXTEN to an animal that results in a gain in time spent within a therapeutic window established for the fusion protein of the composition compared to the corresponding GH component(s) not linked to the fusion protein and administered at a comparable dose to an animal. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold, or at least about 80-fold, or at least about 100-fold longer, compared to the corresponding GH component not linked to the fusion protein and administered at a comparable dose to an animal. The methods further provide that administration of multiple consecutive doses of a GHXTEN administered using a physiologically effective dose regimen to an animal results in a gain in time between consecutive $C_{max}$ peaks and/or $C_{min}$ troughs for blood levels of the fusion protein compared to the corresponding GH not linked to the fusion protein and administered using a dose regimen established for that GH. In the foregoing embodiment, the gain in time spent between consecutive $C_{max}$ peaks and/or $C_{min}$ troughs is at least about three-fold, or at least about four-fold, or at least about five-fold, or at least about six-fold, or at least about eight-fold, or at least about 10-fold, or at least about 20-fold, or at least about 40-fold or at least about 80-fold, or at least about 100-fold longer, compared to the corresponding GH component not linked to the fusion protein and administered using a dose regimen established for that GH. In the embodiments hereinabove described in this paragraph the administration of the fusion protein results in an improvement in at least one of the parameters disclosed herein as being useful using a lower unit dose in moles of fusion protein compared to the corresponding GH component not linked to the fusion protein and administered at a comparable unit dose or dose regimen to an animal.

The method of treatment comprises administration of a GHXTEN using a physiologically effective dose regimen to effect improvements in one or more parameters associated with growth hormone, including, but not limited to IGF-1 and IGFBP3 concentrations, changes in growth velocity, lean body mass, total body fat, muscle mass, bone growth, lactation, duration of lactation, hoof growth, lipolysis, and efficiency of converting feed to meat or milk, measurement of division and multiplication rates of chondrocytes, and/or changes in bone density and/or bone growth. In some embodiments, administration of the GHXTEN to an animal results in an improvement in one or more of the biochemical, physiologic, or clinical parameters that is of greater magnitude than that of the corresponding GH component not linked to XTEN administered to an animal at a comparable dose, determined using the same assay or based on a measured clinical parameter. In one embodiment of the foregoing, the magnitude of improvement in the one or more parameters is at least about 5%, or at least about 6%, or at least about 7% or at least about 8% or at least about 9% or at least about 10%, or at least about 20%, or at least about 30% or more. In other embodiments, administration of the GHXTEN to an animal using a physiologically effective dose regimen results in activity in one or more of the biochemical, physiologic, or clinical parameters that is of longer duration than the activity of one of the single GH components not linked to XTEN, determined using that same assay or based on a measured clinical parameter. In one embodiment of the foregoing, the administration of the GHXTEN to an animal using a physiologically effective dose regimen results in an improvement in peak concentrations and area under the curve of blood IGF-1 levels of at least about 10%, or about 20%, or about 30%, or about 40%, or about 50%, or about 60%, or about 70%, or about 80%, or about 90%, or about 100% or more in the animal compared to a comparable dose of GH not linked to XTEN administered to an animal. In another embodiment of the foregoing, the administration of the GHXTEN to an animal using a physiologically effective dose regimen results in increased weight gain in the animal of at least about 10%, or about 20%, or about 30%, or about 40%, or about 50% or more compared to a comparable dose regimen of the GH not linked to XTEN administered to an animal. In another embodiment of the foregoing, the administration of the GHXTEN to an animal using a physiologically effective dose regimen results in an improvement in milk production of at least about 5%, or at least about 6%, or at least about 7% or at least about 8% or at least about 9% or at least about 10%, or at least about 20%, or at least about 30% or more compared to a comparable dose regimen of the GH not linked to XTEN administered to an animal. In another embodiment of the foregoing, the administration of the GHXTEN to an animal using a physiologically effective dose regimen results in an increase in muscle mass of at least about 5%, or at least about 6%, or at least about 7% or at least about 8% or at least about 9% or at least about 10%, or at least about 20%, or at least about 30% or more compared to a comparable dose regimen of the GH not linked to XTEN administered to an animal.

In another aspect, the invention provides a method of designing the GHXTEN compositions with desired pharmacologic or pharmaceutical properties. The GHXTEN fusion proteins are designed and prepared with various objectives in mind (compared to the GH components not linked to the fusion protein), including improving the efficacy for growth hormone-related parameters and conditions, enhancing the pharmacokinetic characteristics of the fusion proteins compared to the GH, lowering the dose or frequency of dosing required to achieve a pharmacologic effect, enhancing the pharmaceutical properties, and to enhance the ability of the GH components to remain within the therapeutic window for an extended period of time.

Figure 4:
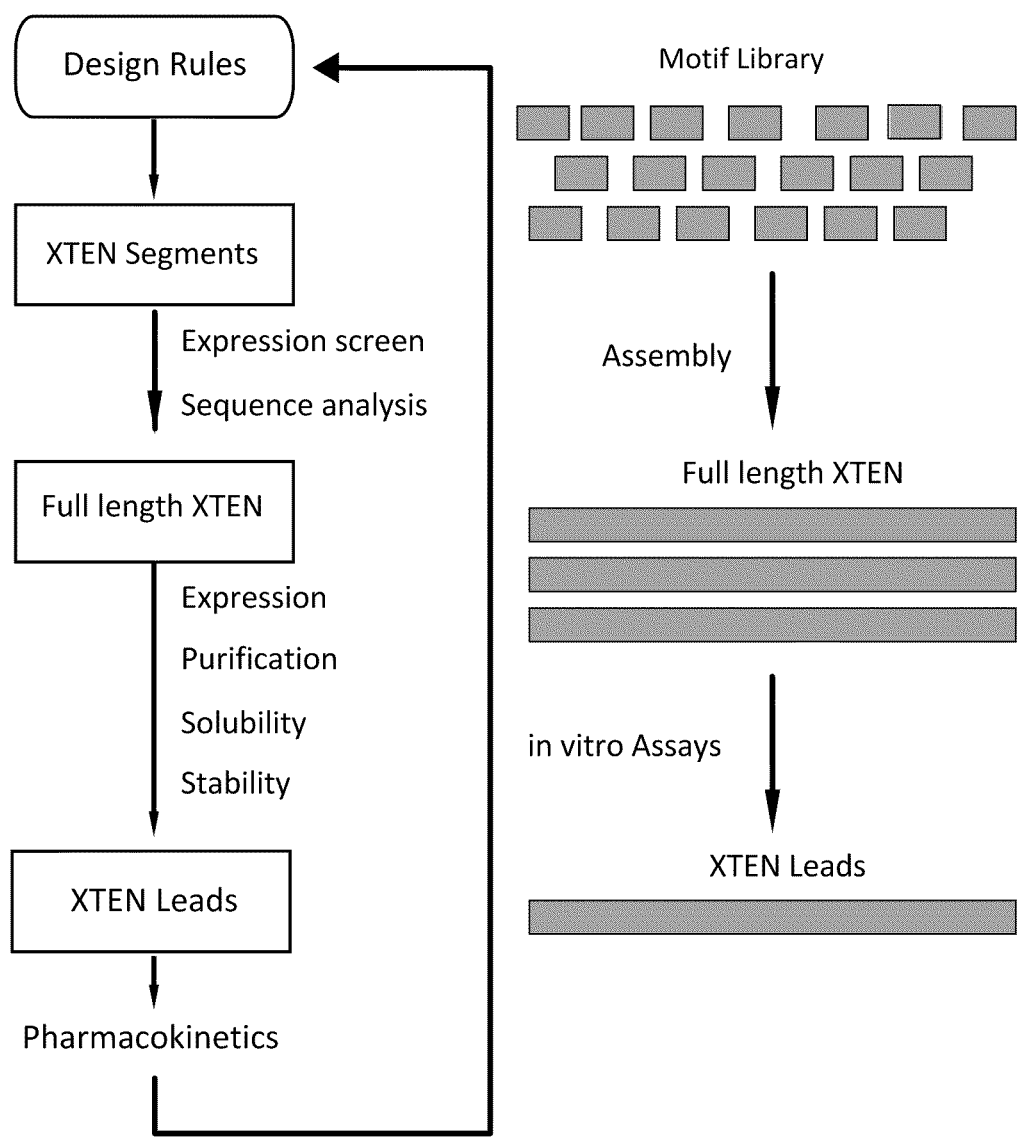
FIG. 4 is a schematic flowchart of representative steps in the assembly, production and the evaluation of a XTEN.
Figure 5:
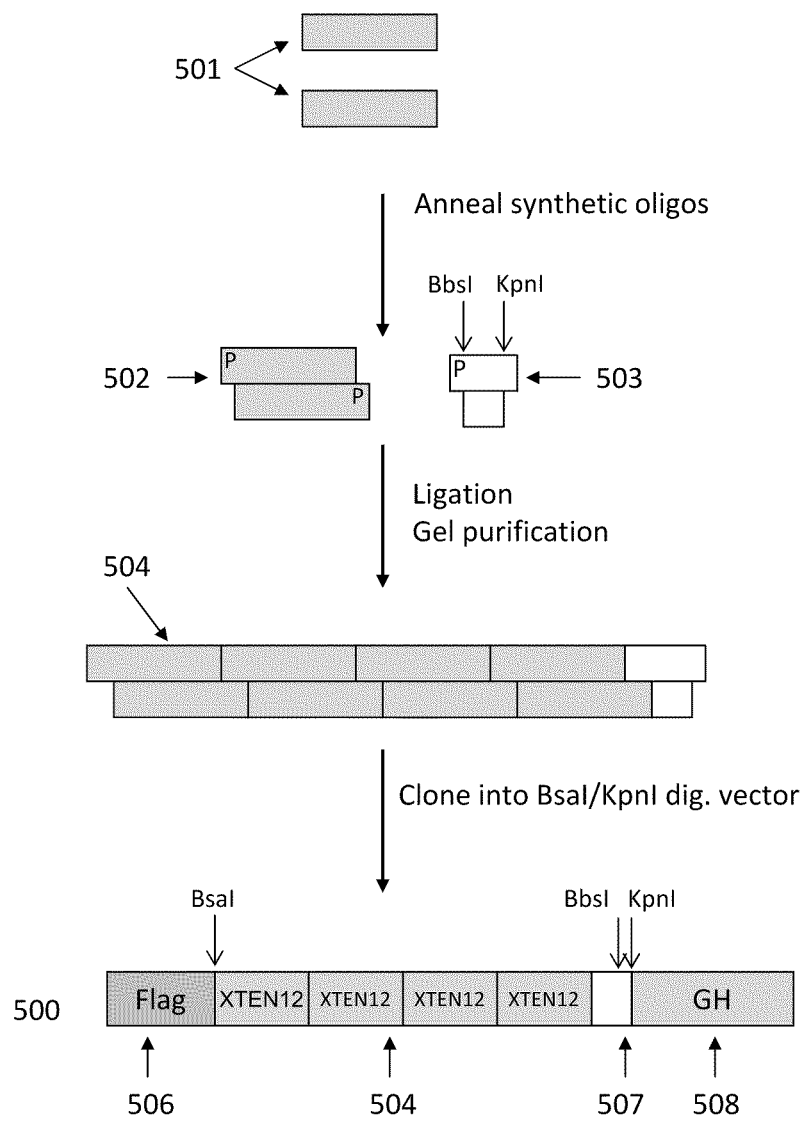
FIG. 5 is a schematic flowchart of representative steps in the assembly of a GHXTEN polynucleotide construct encoding a fusion protein. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector encodes a Flag sequence 506 followed by a stopper sequence that is flanked by BsaI, BbsI, and KpnI sites 507 and an exendin-4 gene 508, resulting in the gene 500 encoding an XTEN-GH fusion protein.
Figure 6:
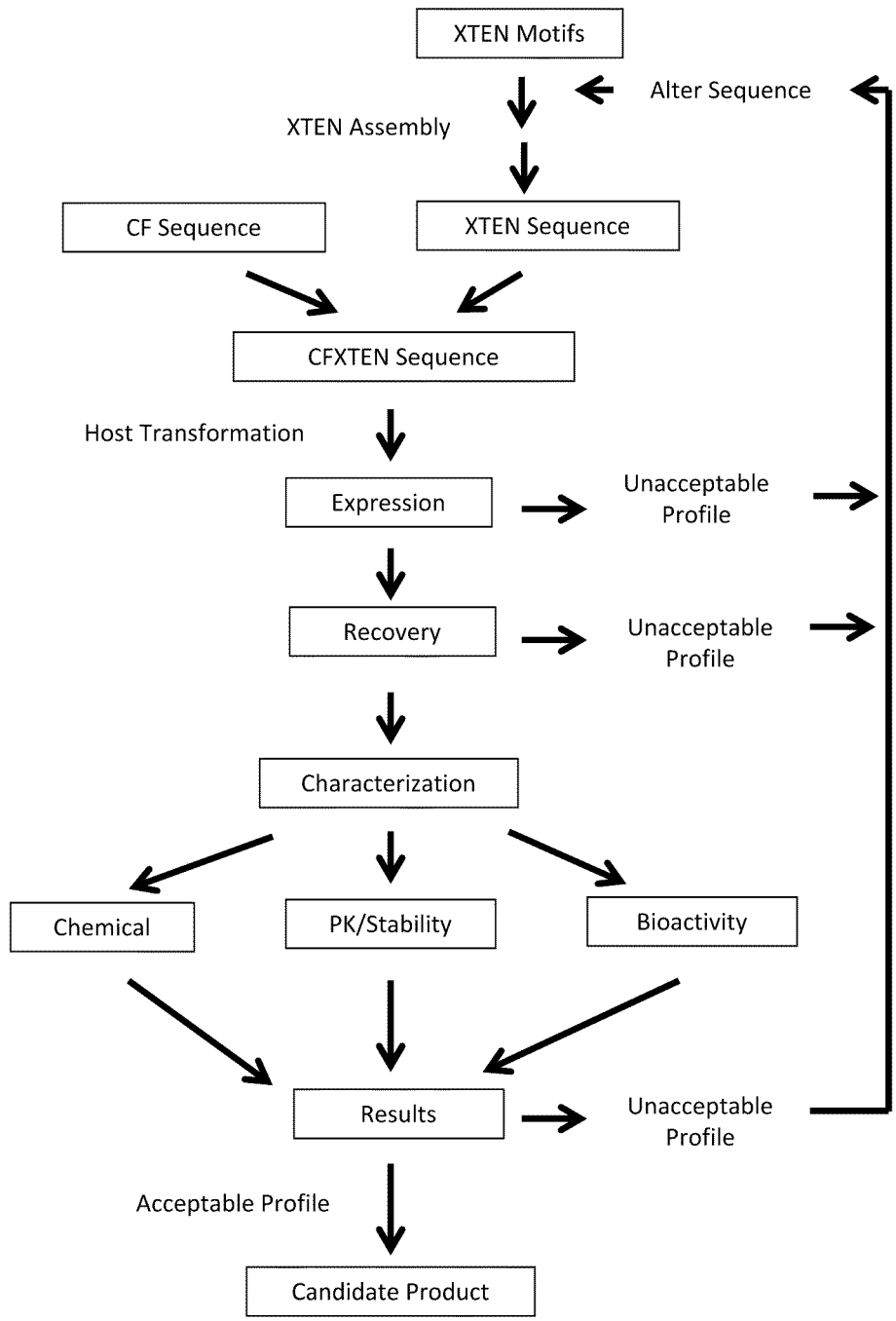
FIG. 6 is a schematic flowchart of representative steps in the assembly of a gene encoding fusion protein comprising a growth hormone (GH) and XTEN, its expression and recovery as a fusion protein, and its evaluation as a candidate GHXTEN product.

In general, the steps in the design and production of the fusion proteins and the inventive compositions, as illustrated in FIGS. 4-6, include: (1) the selection of GHs (e.g., native proteins, analogs or derivatives with activity) to treat the particular animal; (2) selecting the XTEN that will confer the desired PK and physicochemical characteristics on the resulting GHXTEN (e.g., the administration of the composition to an animal results in the fusion protein being maintained within the therapeutic window for a greater period compared to GH not linked to XTEN); (3) establishing a desired N- to C-terminus configuration of the GHXTEN to achieve the desired efficacy or PK parameters; (4) establishing the design of the expression vector encoding the configured GHXTEN; (5) transforming a suitable host with the expression vector; and (6) expression and recovery of the resultant fusion protein. For those GHXTEN for which an increase in half-life (greater than 24 h) or an increased period of time spent within a therapeutic window is desired, the XTEN chosen for incorporation generally has at least about 500, or about 576, or about 864, or about 875, or about 912, or about 923 amino acid residues where a single XTEN is to be incorporated into the GHXTEN. In another embodiment, the GHXTEN comprises a first XTEN of the foregoing lengths, and a second XTEN of about 144, or about 288, or about 576, or about 864, or about 875, or about 912, or about 923 amino acid residues.

In other embodiments, where an increase in half-life is not required, but an increase in a pharmaceutical property (e.g., solubility) is desired, a GHXTEN is designed to include XTEN of shorter lengths. In some embodiments of the foregoing, the GHXTEN comprises a GH linked to an XTEN having at least about 24, or about 36, or about 48, or about 60, or about 72, or about 84, or about 96 amino acid residues, in which the solubility of the fusion protein under physiologic conditions is at least three-fold greater than the corresponding GH not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than GH not linked to XTEN. In one embodiment of the foregoing, the GH is bovine growth hormone.

In another aspect, the invention provides methods of making GHXTEN compositions to improve ease of manufacture, result in increased stability, increased water solubility, and/or ease of formulation, as compared to the native GH. In one embodiment, the invention includes a method of increasing the water solubility of a GH comprising the step of linking the GH to one or more XTEN such that a higher concentration in soluble form of the resulting GHXTEN can be achieved, under physiologic conditions, compared to the GH in an un-fused state. Factors that contribute to the property of XTEN to confer increased water solubility of GHs when incorporated into a fusion protein include the high solubility of the XTEN fusion partner and the low degree of self-aggregation between molecules of XTEN in solution. In some embodiments, the method results in a GHXTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater, or at least about 4000% greater, or at least about 6000% greater under physiologic conditions, compared to the un-fused GH.

In another embodiment, the invention includes a method of increasing the shelf-life of a GH comprising the step of linking the GH with one or more XTEN selected such that the shelf-life of the resulting GHXTEN is extended compared to the GH in an un-fused state. As used herein, shelf-life refers to the period of time over which the functional activity of a GH or GHXTEN that is in solution or in some other storage formulation remains stable without undue loss of activity. As used herein, "functional activity" refers to a pharmacologic effect or biological activity, such as the ability to bind a receptor or ligand, or an enzymatic activity, or to display one or more known functional activities associated with a GH, as known in the art. A GH that degrades or aggregates generally has reduced functional activity or reduced bioavailability compared to one that remains in solution. Factors that contribute to the ability of the method to extend the shelf life of GHs when incorporated into a fusion protein include increased water solubility, reduced self-aggregation in solution, and increased heat stability of the XTEN fusion partner. In particular, the low tendency of XTEN to aggregate facilitates methods of formulating pharmaceutical preparations containing higher drug concentrations of GHs, and the heat-stability of XTEN contributes to the property of GHXTEN fusion proteins to remain soluble and functionally active for extended periods. In one embodiment, the method results in GHXTEN fusion proteins with "prolonged" or "extended" shelf-life that exhibit greater activity relative to a standard that has been animaled to the same storage and handling conditions. The standard may be the un-fused full-length GH. In one embodiment, the method includes the step of formulating the isolated GHXTEN with one or more pharmaceutically acceptable excipients that enhance the ability of the XTEN to retain its unstructured conformation and for the GHXTEN to remain soluble in the formulation for a time that is greater than that of the corresponding un-fused GH. In one embodiment, the method comprises linking a GH to one or more XTEN to create a GHXTEN fusion protein results in a solution that retains greater than about 100% of the functional activity, or greater than about 105%, 110%, 120%, 130%, 150% or 200% of the functional activity of a standard when compared at a given time point and when animaled to the same storage and handling conditions as the standard, thereby increasing its shelf-life.

Shelf-life may also be assessed in terms of functional activity remaining after storage, normalized to functional activity when storage began. GHXTEN fusion proteins of the invention with prolonged or extended shelf-life as exhibited by prolonged or extended functional activity retains about 50% more functional activity, or about 60%, 70%, 80%, or 90% more of the functional activity of the equivalent GH not linked to XTEN when animaled to the same conditions for the same period of time. For example, a GHXTEN fusion protein of the invention comprising growth hormone fused to one or more XTEN sequences retains about 80% or more of its original activity in solution for periods of up to 2 weeks, or 4 weeks, or 6 weeks or longer under various temperature conditions. In some embodiments, the GHXTEN retains at least about 50%, or about 60%, or at least about 70%, or at least about 80%, and most preferably at least about 90% or more of its original activity in solution when heated at 80° C. for 10 min. In other embodiments, the GHXTEN retains at least about 50%, preferably at least about 60%, or at least about 70%, or at least about 80%, or alternatively at least about 90% or more of its original activity in solution when heated or maintained at 37° C. for about 7 days. In another embodiment, GHXTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the GHXTEN is at least about two-fold, or at least about three-fold, or at least about four-fold, or at least about five-fold, or at least about six-fold greater at a given time point than that of the corresponding GH not linked to the fusion protein.

VII). The Nucleic Acids Sequences of the Invention

The present invention provides isolated polynucleic acids encoding GHXTEN fusion proteins and sequences complementary to polynucleic acid molecules encoding GHXTEN fusion proteins, including homologous variants thereof. In another aspect, the invention encompasses methods to produce polynucleic acids encoding GHXTEN fusion proteins and sequences complementary to polynucleic acid molecules encoding GHXTEN fusion protein, including homologous variants thereof. In general, and as illustrated in FIGS. 4-6, the methods of producing a polynucleotide sequence coding for a GHXTEN fusion protein and expressing the resulting gene product include assembling nucleotides encoding GH and XTEN, ligating the components in frame, incorporating the encoding gene into an expression vector appropriate for a host cell, transforming the appropriate host cell with the expression vector, and culturing the host cell under conditions causing or permitting the fusion protein to be expressed in the transformed host cell, thereby producing the biologically-active GHXTEN polypeptide, which is recovered as an isolated fusion protein by standard protein purification methods known in the art. Standard recombinant techniques in molecular biology is used to make the polynucleotides and expression vectors of the present invention.

In accordance with the invention, nucleic acid sequences that encode GHXTEN (or its complement) is used to generate recombinant DNA molecules that direct the expression of GHXTEN fusion proteins in appropriate host cells. Several cloning strategies are suitable for performing the present invention, many of which is used to generate a construct that comprises a gene coding for a fusion protein of the GHXTEN composition of the present invention, or its complement. In some embodiments, the cloning strategy is used to create a gene that encodes a monomeric GHXTEN that comprises at least a first GH and at least a first XTEN polypeptide, or their complement. In one embodiment of the foregoing, the gene comprises a sequence encoding a bGH or a sequence variant. In other embodiments, the cloning strategy is used to create a gene that encodes a monomeric GHXTEN that comprises nucleotides encoding at least a first molecule of GH or its complement and a first and at least a second XTEN or their complement that is used to transform a host cell for expression of the fusion protein of the GHXTEN composition. In the foregoing embodiments hereinabove described in this paragraph, the genes can further comprise nucleotides encoding spacer sequences that also encodes cleavage sequence(s).

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 4 and 5 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to GHXTEN fusion protein. DNA encoding the GH of the compositions is obtained from a cDNA library prepared using standard methods from tissue or isolated cells believed to possess GH mRNA and to express it at a detectable level. Libraries is screened with probes containing, for example, about 20 to 100 bases designed to identify the GH gene of interest by hybridization using conventional molecular biology techniques. The best candidates for probes are those that represent sequences that are highly homologous for native growth hormone, and should be of sufficient length and sufficiently unambiguous that false positives are minimized, but may be degenerate at one or more positions. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the GHXTEN constructs containing the GH gene(s). Assays can then be conducted to confirm that hybridizing full-length genes are the desired GH gene(s). By these conventional methods, DNA can be conveniently obtained from a cDNA library prepared from such sources. The GH encoding gene(s) is also be obtained from a genomic library or created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the GH encoding gene encodes a protein from any one of Table 1, or a fragment or variant thereof.

A gene or polynucleotide encoding the GH portion of the animal GHXTEN protein, in the case of an expressed fusion protein that comprises a single GH is then be cloned into a construct, which is a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the GH gene by cloning it into the construct adjacent and in frame with the gene(s) coding for the GH. This second step occurs through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 36 amino acids, or about 48 to about 144 amino acids, or about 144 to about 288 or longer, or any combination of the foregoing ranges of motif or segment lengths.

Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit being used, which can reduce recombination and increase stability of the encoding gene in the transformed host. Genes encoding XTEN with non-repetitive sequences is assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 4 and 5. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage. Exemplary methods to achieve the foregoing are disclosed in the Examples.

Polynucleotide Libraries

In another aspect, the invention provides libraries of polynucleotides that encode XTEN sequences that is used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the GHXTEN fusion protein, as disclosed herein. In some embodiments, libraries are assembled of polynucleotides that encode amino acids that are limited to specific sequence XTEN families; e.g., AD, AE, AF, AG, AM, or AQ sequences of Table 2. In other embodiments, libraries comprise sequences that encode two or more of the motif family sequences from Table 2. The names and sequences of representative, non-limiting polynucleotide sequences of libraries that encode 36 mers are presented in Tables 8-11, and the methods used to create them are described more fully in the Examples. In other embodiments, libraries that encode XTEN are constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of condons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 48, 72, 144, 288, 576, 864, 875, 912, 923, 1318 amino acids, or up to a total length of about 3000 amino acids, as well as intermediate lengths, in which the encoded XTEN can have one or more of the properties disclosed herein, when expressed as a component of a GHXTEN fusion protein. In some cases, the polynucleotide library sequences may also include additional bases used as "sequencing islands," described more fully below.

FIG. 5 is a schematic flowchart of representative, non-limiting steps in the assembly of a XTEN polynucleotide construct and a GHXTEN polynucleotide construct in the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector optionally encodes a Flag sequence 506 followed by a stuffer sequence that is flanked by BsaI, BbsI, and KpnI sites 507 and, in this case, a single GH gene (encoding bGH in this example) 508, resulting in the gene encoding a GHXTEN comprising a single GH 500. A non-exhaustive list of the XTEN names for polynucleotides encoding XTEN and precursor sequences is provided in Table 7.

TABLE 7

DNA sequences of XTEN and precursor sequences

| XTEN Name | SEQ ID NO: | DNA Nucleotide Sequence |
|---|---|---|
| AE48 | 107 | ATGGCTGAACCTGCTGGCTCTCCAACCTCCACTGAGGAAGGTACCCCGGGTA GCGGTACTGCTTCTTCCTCTCCAGGTAGCTCTACCCCTTCTGGTGCAACCGGC TCTCCAGGTGCTTCTCCGGGCACCAGCTCTACCGGTTCT |
| AM48 | 108 | ATGGCTGAACCTGCTGGCTCTCCAACCTCCACTGAGGAAGGTGCATCCCCGG GCACCAGCTCTACCGGTTCTCCAGGTAGCTCTACCCCGTCTGGTGCTACCGG CTCTCCAGGTAGCTCTACCCCGTCTGGTGCTACTGGCTCT |
| AE144 | 109 | GGTAGCGAACCGGCAACTTCCGGCTCTGAAACCCCAGGTACTTCTGAAAGC GCTACTCCTGAGTCTGGCCCAGGTAGCGAACCTGCTACCTCTGGCTCTGAAA CCCCAGGTAGCCCGGCAGGCTCTCCGACTTCCACCGAGGAAGGTACCTCTAC TGAACCTTCTGAGGGTAGCGCTCCAGGTAGCGAACCGGCAACCTCTGGCTCT GAAACCCCAGGTAGCGAACCTGCTACCTCCGGCTCTGAAACTCCAGGTAGC GAACCGGCTACTTCCGGTTCTGAAACTCCAGGTACCTCTACCGAACCTTCCG AAGGCAGCGCACCAGGTACTTCTGAAAGCGCAACCCCTGAATCCGGTCCAG GTAGCGAACCGGCTACTTCTGGCTCTGAGACTCCAGGTACTTCTACCGAACC GTCCGAAGGTAGCGCACCA |
| AF144 | 110 | GGTACTTCTACTCCGGAAAGCGGTTCCGCATCTCCAGGTACTTCTCCTAGCG GTGAATCTTCTACTGCTCCAGGTACCTCTCCTAGCGGCGAATCTTCTACTGCT CCAGGTTCTACCAGCTCTACCGCTGAATCTCCTGGCCCAGGTTCTACCAGCG AATCCCCGTCTGGCACCGCACCAGGTTCTACTAGCTCTACCGCAGAATCTCC GGGTCCAGGTACTTCCCCTAGCGGTGAATCTTCTACTGCTCCAGGTACCTCT ACTCCGGAAAGCGGCTCCGCATCTCCAGGTTCTACTAGCTCTACTGCTGAAT CTCCTGGTCCAGGTACCTCCCCTAGCGGCGAATCTTCTACTGCTCCAGGTAC CTCTCCTAGCGGCGAATCTTCTACCGCTCCAGGTACCTCCCCTAGCGGTGAA TCTTCTACCGCACCA |
| AE288 | 111 | GGTACCTCTGAAAGCGCAACTCCTGAGTCTGGCCCAGGTAGCGAACCTGCT ACCTCCGGCTCTGAGACTCCAGGTACCTCTGAAAGCGCAACCCCGGAATCTG GTCCAGGTAGCGAACCTGCAACCTCTGGCTCTGAAACCCCAGGTACCTCTGA AAGCGCTACTCCTGAATCTGGCCCAGGTACTTCTACTGAACCGTCCGAGGGC AGCGCACCAGGTAGCCCTGCTGGCTCTCCAACCTCCACCGAAGAAGGTACC TCTGAAAGCGCAACCCCTGAATCCGGCCCAGGTAGCGAACCGGCAACCTCC GGTTCTGAAACCCCAGGTACTTCTGAAAGCGCTACTCCTGAGTCCGGCCCAG GTAGCCCGGCTGGCTCTCCGACTTCCACCGAGGAAGGTAGCCGGCTGGCTC TCCAACTTCTACTGAAGAAGGTACTTCTACCGAACCTTCCGAGGGCAGCGCA CCAGGTACTTCTGAAAGCGCTACCCCTGAGTCCGGCCCAGGTACTTCTGAAA GCGCTACTCCTGAATCCGGTCCAGGTACTTCTGAAAGCGCTACCCCGGAATC TGGCCCAGGTAGCGAACCGGCTACTTCTGGTTCTGAAACCCCAGGTAGCGA ACCGGCTACCTCCGGTTCTGAAACTCCAGGTAGCCCAGCAGGCTCTCCGACT TCCACTGAGGAAGGTACTTCTACTGAACCTTCCGAAGGCAGCGCACCAGGT ACCTCTACTGAACCTTCTGAGGGCAGCGCTCCAGGTAGCGAACCTGCAACCT CTGGCTCTGAAACCCCAGGTACCTCTGAAAGCGCTACTCCTGAATCTGGCCC AGGTACTTCTACTGAACCGTCCGAGGGCAGCGCACCA |
| AE576 | 112 | GGTAGCCCGGCTGGCTCTCCTACCTCTACTGAGGAAGGTACTTCTGAAAGCG CTACTCCTGAGTCTGGTCCAGGTACCTCTACTGAACCGTCCGAAGGTAGCGC TCCAGGTAGCCCAGCAGGCTCTCCGACTTCCACTGAGGAAGGTACTTCTACT GAACCTTCCGAAGGCAGCGCACCAGGTACCTCTACTGAACCTTCTGAGGGC AGCGCTCCAGGTACTTCTGAAAGCGCTACCCCGGAATCTGGCCCAGGTAGC GAACCGGCTACTTCTGGTTCTGAAACCCCAGGTAGCGAACCGGCTACCTCCG GTTCTGAAACTCCAGGTAGCCCGGCAGGCTCTCCGACCTCTACTGAGGAAG GTACTTCTGAAAGCGCAACCCCGGAGTCCGGCCCAGGTACCTCTACCGAAC |

TABLE 7-continued

DNA sequences of XTEN and precursor sequences

| XTEN Name | SEQ ID NO: | DNA Nucleotide Sequence |
|---|---|---|
| | | CGTCTGAGGGCAGCGCACCAGGTACTTCTACCGAACCGTCCGAGGGTAGCG<br>CACCAGGTAGCCCAGCAGGTTCTCCTACCTCCACCGAGGAAGGTACTTCTAC<br>CGAACCGTCCGAGGGTAGCGCACCAGGTACCTCTACTGAACCTTCTGAGGG<br>CAGCGCTCCAGGTACTTCTGAAAGCGCTACCCCGGAGTCCGGTCCAGGTACT<br>TCTACTGAACCGTCCGAAGGTAGCGCACCAGGTACTTCTGAAAGCGCAACC<br>CCTGAATCCGGTCCAGGTAGCGAACCGGCTACTTCTGGCTCTGAGACTCCAG<br>GTACTTCTACCGAACCGTCCGAAGGTAGCGCACCAGGTACTTCTACTGAACC<br>GTCTGAAGGTAGCGCACCAGGTACTTCTGAAAGCGCAACCCCGGAATCCGG<br>CCCAGGTACCTCTGAAAGCGCAACCCCGGAGTCCGGCCCAGGTAGCCCTGC<br>TGGCTCTCCAACCTCCACCGAAGAAGGTACCTCTGAAAGCGCAACCCCTGA<br>ATCCGGCCCAGGTAGCGAACCGGCAACCTCCGGTTCTGAAACCCCAGGTAC<br>CTCTGAAAGCGCTACTCCGGAGTCTGGCCCAGGTACCTCTACTGAACCGTCT<br>GAGGGTAGCGCTCCAGGTACTTCTACTGAACCGTCCGAAGGTAGCGCACCA<br>GGTACTTCTACCGAACCGTCCGAAGGCAGCGCTCCAGGTACCTCTACTGAAC<br>CTTCCGAGGGCAGCGCTCCAGGTACCTCTACCGAACCTTCTGAAGGTAGCGC<br>ACCAGGTACTTCTACCGAACCGTCCGAGGGTAGCGCACCAGGTAGCCCAGC<br>AGGTTCTCCTACCTCCACCGAGGAAGGTACTTCTACCGAACCGTCCGAGGGT<br>AGCGCACCAGGTACCTCTGAAAGCGCAACTCCTGAGTCTGGCCCAGGTAGC<br>GAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAG<br>GTACCTCTGAAAGCGCTACTCCTGAATCTGGCCCAGGTACTTCTACTGAACC<br>GTCCGAGGGCAGCGCACCAGGTACTTCTGAAAGCGCTACTCCTGAGTCCGG<br>CCCAGGTAGCCCGGCTGGCTCTCCGACTTCCACCGAGGAAGGTAGCCCGGC<br>TGGCTCTCCAACTTCTACTGAAGAAGGTAGCCCGGCAGGCTCTCCGACCTCT<br>ACTGAGGAAGGTACTTCTGAAAGCGCAACCCCGGAGTCCGGCCCAGGTACC<br>TCTACCGAACCGTCTGAGGGCAGCGCACCA |
| AF576 | 113 | GGTTCTACTAGCTCTACCGCTGAATCTCCTGGCCCAGGTTCCACTAGCTCTA<br>CCGCAGAATCTCCGGGCCCAGGTTCTACTAGCGAATCCCCTTCTGGTACCGC<br>TCCAGGTTCTACTAGCTCTACCGCTGAATCTCCGGGTCCAGGTTCTACCAGC<br>TCTACTGCAGAATCTCCTGGCCCAGGTACTTCTACTCCGGAAAGCGGTTCCG<br>CTTCTCCAGGTTCTACCAGCGAATCTCCTTCTGGCACCGCTCCAGGTACCTCT<br>CCTAGCGGCGAATCTTCTACCGCTCCAGGTTCTACTAGCGAATCTCCTTCTG<br>GCACTGCACCAGGTTCTACCAGCGAATCTCCTTCTGGCACCGCTCCAGGTAC<br>CTCTCCTAGCGGCGAATCTTCTACCGCTCCAGGTTCTACTAGCGAATCTCCTT<br>CTGGCACTGCACCAGGTTCTACCAGCGAATCTCCTTCTGGCACCGCTCCAGG<br>TACCTCTCCTAGCGGCGAATCTTCTACCGCTCCAGGTTCTACTAGCGAATCT<br>CCTTCTGGCACTGCACCAGGTTCTACTAGCGAATCTCCTTCTGGCACTGCAC<br>CAGGTTCTACCAGCGAATCTCCGTCTGGCACTGCACCAGGTACCTCTACCCC<br>TGAAAGCGGTTCCGCTTCTCCAGGTTCTACTAGCGAATCTCCTTCTGGTACC<br>GCTCCAGGTACTTCTACCCCTGAAAGCGGCTCCGCTTCTCCAGGTTCCACTA<br>GCTCTACCGCTGAATCTCCGGGTCCAGGTTCTACTAGCTCTACTGCAGAATC<br>TCCTGGCCCAGGTACCTCTACTCCGGAAAGCGGCTCTGCATCTCCAGGTACT<br>TCTACCCCTGAAAGCGGTTCTGCATCTCCAGGTTCTACTAGCGAATCCCCGT<br>CTGGTACCGCACCAGGTACTTCTACCCCGGAAAGCGGCTCTGCTTCTCCAGG<br>TACTTCTACCCCGGAAAGCGGCTCCGCATCTCCAGGTTCTACTAGCGAATCT<br>CCTTCTGGTACCGCTCCAGGTTCTACCAGCGAATCCCCGTCTGGTACTGCTC<br>CAGGTTCTACCAGCGAATCTCCTTCTGGTACTGCACCAGGTTCTACTAGCTC<br>TACTGCAGAATCTCCTGGCCCAGGTACCTCTACTCCGGAAAGCGGCTCTGCA<br>TCTCCAGGTACTTCTACCCCTGAAAGCGGTTCTGCATCTCCAGGTTCTACTA<br>GCGAATCTCCTTCTGGCACTGCACCAGGTTCTACCAGCGAATCTCCGTCTGG<br>CACTGCACCAGGTACCTCTACCCCTGAAAGCGGTTCCGCTTCTCCAGGTTCT<br>ACTAGCGAATCTCCTTCTGGCACTGCACCAGGTTCTACCAGCGAATCTCCGT<br>CTGGCACTGCACCAGGTACCTCTACCCCTGAAAGCGGTTCCGCTTCTCCAGG<br>TACTTCTCCGAGCGGTGAATCTTCTACCGCACCAGGTTCTACTAGCTCTACC<br>GCTGAATCTCCGGGCCCAGGTACTTCTCCGAGCGGTGAATCTTCTACTGCTC<br>CAGGTTCCACTAGCTCTACTGCTGAATCTCCTGGCCCAGGTACTTCTACTCC<br>GGAAAGCGGTTCCGCTTCTCCAGGTTCTACTAGCGAATCTCCGTCTGGCACC<br>GCACCAGGTTCTACTAGCTCTACTGCAGAATCTCCTGGCCCAGGTACCTCTA<br>CTCCGGAAAGCGGCTCTGCATCTCCAGGTACTTCTACCCCTGAAAGCGGTTC<br>TGCATCTCCA |
| AE624 | 114 | ATGGCTGAACCTGCTGGCTCTCCAACCTCCACTGAGGAAGGTACCCCGGGTA<br>GCGGTACTGCTTCTTCCTCTCCAGGTAGCTCTACCCCTTCTGGTGCAACCGGC<br>TCTCCAGGTGCTTCTCCGGGCACCAGCTCTACCGGTTCTCCAGGTAGCCCGG<br>CTGGCTCTCCTACCTCTACTGAGGAAGGTACTTCTGAAAGCGCTACTCCTGA<br>GTCTGGTCCAGGTACCTCTACTGAACCGTCCGAAGGTAGCGCTCCAGGTAGC<br>CCAGCAGGCTCTCCGACTTCCACTGAGGAAGGTACTTCTACTGAACCTTCCG<br>AAGGCAGCGCACCAGGTACCTCTACTGAACCTTCTGAGGGCAGCGCTCCAG<br>GTACTTCTGAAAGCGCTACCCCGGAATCTGGCCCAGGTAGCGAACCGGCTA<br>CTTCTGGTTCTGAAACCCCAGGTAGCGAACCGGCTACCTCCGGTTCTGAAAC<br>TCCAGGTAGCCCGGCAGGCTCTCCGACCTCTACTGAGGAAGGTACTTCTGAA<br>AGCGCAACCCCGGAGTCCGGCCCAGGTACCTCTACCGAACCGTCTGAGGGC<br>AGCGCACCAGGTACTTCTACCGAACCGTCCGAGGGTAGCGCACCAGGTAGC<br>CCAGCAGGTTCTCCTACCTCCACCGAGGAAGGTACTTCTACCGAACCGTCCG |

TABLE 7-continued

DNA sequences of XTEN and precursor sequences

| XTEN Name | SEQ ID NO: | DNA Nucleotide Sequence |
|---|---|---|
| | | AGGGTAGCGCACCAGGTACCTCTACTGAACCTTCTGAGGGCAGCGCTCCAG<br>GTACTTCTGAAAGCGCTACCCCGGAGTCCGGTCCAGGTACTTCTACTGAACC<br>GTCCGAAGGTAGCGCACCAGGTACTTCTGAAAGCGCAACCCCTGAATCCGG<br>TCCAGGTAGCGAACCGGCTACTTCTGGCTCTGAGACTCCAGGTACTTCTACC<br>GAACCGTCCGAAGGTAGCGCACCAGGTACTTCTACTGAACCGTCTGAAGGT<br>AGCGCACCAGGTACTTCTGAAAGCGCAACCCCGGAATCCGGCCCAGGTACC<br>TCTGAAAGCGCAACCCCGGAGTCCGGCCCAGGTAGCCCTGCTGGCTCTCCA<br>ACCTCCACCGAAGAAGGTACCTCTGAAAGCGCAACCCCTGAATCCGGCCCA<br>GGTAGCGAACCGGCAACCTCCGGTTCTGAAACCCCAGGTACCTCTGAAAGC<br>GCTACTCCGGAGTCTGGCCCAGGTACCTCTACTGAACCGTCTGAGGGTAGCG<br>CTCCAGGTACTTCTACTGAACCGTCCGAAGGTAGCGCACCAGGTACTTCTAC<br>CGAACCGTCCGAAGGCAGCGCTCCAGGTACCTCTACTGAACCTTCCGAGGG<br>CAGCGCTCCAGGTACCTCTACCGAACCTTCTGAAGGTAGCGCACCAGGTACT<br>TCTACCGAACCGTCCGAGGGTAGCGCACCAGGTAGCCCAGCAGGTTCTCCT<br>ACCTCCACCGAGGAAGGTACTTCTACCGAACCGTCCGAGGGTAGCGCACCA<br>GGTACCTCTGAAAGCGCAACTCCTGAGTCTGGCCCAGGTAGCGAACCTGCT<br>ACCTCCGGCTCTGAGACTCCAGGTACCTCTGAAAGCGCAACCCCGGAATCTG<br>GTCCAGGTAGCGAACCTGCAACCTCTGGCTCTGAAACCCCAGGTACCTCTGA<br>AAGCGCTACTCCTGAATCTGGCCCAGGTACTTCTACTGAACCGTCCGAGGGC<br>AGCGCACCAGGTACTTCTGAAAGCGCTACTCCTGAGTCCGGCCCAGGTAGC<br>CCGGCTGGCTCTCCGACTTCCACCGAGGAAGGTAGCCCGGCTGGCTCTCCAA<br>CTTCTACTGAAGAAGGTAGCCCGGCAGGCTCTCCGACCTCTACTGAGGAAG<br>GTACTTCTGAAAGCGCAACCCCGGAGTCCGGCCCAGGTACCTCTACCGAAC<br>CGTCTGAGGGCAGCGCACCA |
| AM875 | 115 | GGTACTTCTACTGAACCGTCTGAAGGCAGCGCACCAGGTAGCGAACCGGCT<br>ACTTCCGGTTCTGAAACCCCAGGTAGCCCAGCAGGTTCTCCAACTTCTACTG<br>AAGAAGGTTCTACCAGCTCTACCGCAGAATCTCCTGGTCCAGGTACCTCTAC<br>TCCGGAAAGCGGCTCTGCATCTCCAGGTTCTACTAGCGAATCTCCTTCTGGC<br>ACTGCACCAGGTTCTACTAGCGAATCCCGTCTGGTACTGCTCCAGGTACTT<br>CTACTCCTGAAAGCGGTTCCGCTTCTCCAGGTACCTCTACTCCGGAAAGCGG<br>TTCTGCATCTCCAGGTAGCGAACCGGCAACCTCCGGCTCTGAAACCCCAGGT<br>ACCTCTGAAAGCGCTACTCCTGAATCCGGCCCAGGTAGCCCGGCAGGTTCTC<br>CGACTTCCACTGAGGAAGGTACCTCTACTGAACCTTCTGAGGGCAGCGCTCC<br>AGGTACTTCTGAAAGCGCTACCCCGGAGTCCGGTCCAGGTACTTCTACTGAA<br>CCGTCCGAAGGTAGCGCACCAGGTACTTCTACCGAACCGTCCGAGGGTAGC<br>GCACCAGGTAGCCCAGCAGGTTCTCCTACCTCCACCGAGGAAGGTACTTCTA<br>CCGAACCGTCCGAGGGTAGCGCACCAGGTACTTCTACCGAACCTTCCGAGG<br>GCAGCGCACCAGGTACTTCTGAAAGCGCTACCCCTGAGTCCGGCCCAGGTA<br>CTTCTGAAAGCGCTACTCCTGAATCCGGTCCAGGTACCTCTACTGAACCTTC<br>CGAAGGCAGCGCTCCAGGTACCTCTACCGAACCGTCCGAGGGCAGCGCACC<br>AGGTACTTCTGAAAGCGCAACCCCTGAATCCGGTCCAGGTACTTCTACTGAA<br>CCTTCCGAAGGTAGCGCTCCAGGTAGCGAACCTGCTACTTCTGGTTCTGAAA<br>CCCCAGGTAGCCCGGCTGGCTCTCCGACCTCCACCGAGGAAGGTAGCTCTAC<br>CCCGTCTGGTGCTACTGGTTCTCCAGGTACTCCGGGCAGCGGTACTGCTTCT<br>TCCTCTCCAGGTAGCTCTACCCCTTCTGGTGCTACTGGCTCTCCAGGTACCTC<br>TACCGAACCGTCCGAGGGTAGCGCACCAGGTACCTCTACTGAACCGTCTGA<br>GGGTAGCGCTCCAGGTAGCGAACCGGCAACCTCCGGTTCTGAAACTCCAGG<br>TAGCCCTGCTGGCTCTCCGACTTCTACTGAGGAAGGTAGCCCGGCTGGTTCT<br>CCGACTTCTACTGAGGAAGGTACTTCTACCGAACCTTCCGAAGGTAGCGCTC<br>CAGGTGCAAGCGCAAGCGGCGCGCCAAGCACGGGAGGTACTTCTGAAAGCG<br>CTACTCCTGAGTCCGGCCCAGGTAGCCCGGCTGGCTCTCCGACTTCCACCGA<br>GGAAGGTAGCCCGGCTGGCTCTCCAACTTCTACTGAAGAAGGTTCTACCAGC<br>TCTACCGCTGAATCTCCTGGCCCAGGTTCTACTAGCGAATCTCCGTCTGGCA<br>CCGCACCAGGTACTTCCCTAGCGGTGAATCTTCTACTGCACCAGGTACCCC<br>TGGCAGCGGTACCGCTTCTTCCTCTCCAGGTAGCTCTACCCCGTCTGGTGCT<br>ACTGGCTCTCCAGGTTCTAGCCCGTCTGCATCTACCGGTACCGGCCCAGGTA<br>GCGAACCGGCAACCTCCGGCTCTGAAACTCCAGGTACTTCTGAAAGCGCTA<br>CTCCGGAATCCGGCCCAGGTAGCGAACCGGCTACTTCCGGCTCTGAAACCCC<br>AGGTTCCACCAGCTCTACTGCAGAATCTCCGGGCCCAGGTTCTACTAGCTCT<br>ACTGCAGAATCTCCGGGTCCAGGTACTTCTCCTAGCGGCGAATCTTCTACCG<br>CTCCAGGTAGCGAACCGGCAACCTCTGGCTCTGAAACTCCAGGTAGCGAAC<br>CTGCAACCTCCGGCTCTGAAACCCCAGGTACTTCTACTGAACCTTCTGAGGG<br>CAGCGCACCAGGTTCTACCAGCTCTACCGCAGAATCTCCTGGTCCAGGTACC<br>TCTACTCCGGAAAGCGGCTCTGCATCTCCAGGTTCTACTAGCGAATCTCCTT<br>CTGGCACTGCACCAGGTACTTCTACCGAACCGTCCGAAGGCAGCGCTCCAG<br>GTACCTCTACTGAACCTTCCGAGGGCAGCGCTCCAGGTACCTCTACCGAACC<br>TTCTGAAGGTAGCGCACCAGGTAGCTCTACTCCGTCGGTGCAACCGGCTCC<br>CCAGGTTCTAGCCCGTCTGCTTCCACTGGTACTGGCCAGGTGCTTCCCCGG<br>GCACCAGCTCTACTGGTTCTCCAGGTAGCGAACCTGCTACCTCCGGTTCTGA<br>AACCCCAGGTACCTCTGAAAGCGCAACTCCGGAGTCTGGTCAGGTAGCCC<br>TGCAGGTTCTCCTACCTCCACTGAGGAAGGTAGCTCTACTCCGTCTGGTGCA<br>ACCGGCTCCCCAGGTTCTAGCCCGTCTGCTTCCACTGGTACTGGCCCAGGTG<br>CTTCCCCGGGCACCAGCTCTACTGGTTCTCCAGGTACCTCTGAAAGCGCTAC |

TABLE 7-continued

DNA sequences of XTEN and precursor sequences

| XTEN Name | SEQ ID NO: | DNA Nucleotide Sequence |
|---|---|---|
| | | TCCGGAGTCTGGCCCAGGTACCTCTACTGAACCGTCTGAGGGTAGCGCTCCA<br>GGTACTTCTACTGAACCGTCCGAAGGTAGCGCACCA |
| AE864 | 116 | GGTAGCCCGGCTGGCTCTCCTACCTCTACTGAGGAAGGTACTTCTGAAAGCG<br>CTACTCCTGAGTCTGGTCCAGGTACCTCTACTGAACCGTCCGAAGGTAGCGC<br>TCCAGGTAGCCCAGCAGGCTCTCCGACTTCCACTGAGGAAGGTACTTCTACT<br>GAACCTTCCGAAGGCAGCGCACCAGGTACCTCTACTGAACCTTCTGAGGGC<br>AGCGCTCCAGGTACTTCTGAAAGCGCTACCCCGGAATCTGGCCCAGGTAGC<br>GAACCGGCTACTTCTGGTTCTGAAACCCAGGTAGCGAACCGGCTACCTCCG<br>GTTCTGAAACTCCAGGTAGCCCGGCAGGCTCTCCGACCTCTACTGAGGAAG<br>GTACTTCTGAAAGCGCAACCCCGGAGTCCGGCCCAGGTACCTCTACCGAAC<br>CGTCTGAGGGCAGCGCACCAGGTACTTCTACCGAACCGTCCGAGGGTAGCG<br>CACCAGGTAGCCCAGCAGGTTCTCCTACCTCCACCGAGGAAGGTACTTCTAC<br>CGAACCGTCCGAGGGTAGCGCACCAGGTACCTCTACTGAACCTTCTGAGGG<br>CAGCGCTCCAGGTACTTCTGAAAGCGCTACCCCGGAGTCCGGTCCAGGTACT<br>TCTACTGAACCGTCCGAAGGTAGCGCACCAGGTACTTCTGAAAGCGCAACC<br>CCTGAATCCGGTCCAGGTAGCGAACCGGCTACTTCTGGCTCTGAGACTCCAG<br>GTACTTCTACCGAACCGTCCGAAGGTAGCGCACCAGGTACTTCTACTGAACC<br>GTCTGAAGGTAGCGCACCAGGTACTTCTGAAAGCGCAACCCCGGAATCCGG<br>CCCAGGTACCTCTGAAAGCGCAACCCCGGAGTCCGCCCAGGTAGCCCTGC<br>TGGCTCTCCAACCTCCACCGAAGAAGGTACCTCTGAAAGCGCAACCCCTGA<br>ATCCGGCCCAGGTAGCGAACCGGCAACCTCCGGTTCTGAAACCCCAGGTAC<br>CTCTGAAAGCGCTACTCCGGAGTCTGGCCCAGGTACCTCTACTGAACCGTCT<br>GAGGGTAGCGCTCCAGGTACTTCTACTGAACCGTCCGAAGGTAGCGCACCA<br>GGTACTTCTACCGAACCGTCCGAAGGCAGCGCTCCAGGTACCTCTACTGAAC<br>CTTCCGAGGGCAGCGCTCCAGGTACCTCTACCGAACCTTCTGAAGGTAGCGC<br>ACCAGGTACTTCTACCGAACCGTCCGAGGGTAGCGCACCAGGTAGCCCAGC<br>AGGTTCTCCTACCTCCACCGAGGAAGGTACTTCTACCGAACCGTCCGAGGGT<br>AGCGCACCAGGTACCTCTGAAAGCGCAACTCCTGAGTCTGGCCCAGGTAGC<br>GAACCTGCTACCTCCGGCTCTGAGACTCCAGGTACCTCTGAAAGCGCAACCC<br>CGGAATCTGGTCCAGGTAGCGAACCTGCAACCTCTGGCTCTGAAACCCCAG<br>GTACCTCTGAAAGCGCTACTCCTGAATCTGGCCCAGGTACTTCTACTGAACC<br>GTCCGAGGGCAGCGCACCAGGTACTTCTGAAAGCGCTACTCCTGAGTCCGG<br>CCCAGGTAGCCCGGCTGGCTCTCCGACTTCCACCGAGGAAGGTAGCCCGGC<br>TGGCTCTCCAACTTCTACTGAAGAAGGTAGCCCGGCAGGCTCTCCGACCTCT<br>ACTGAGGAAGGTACTTCTGAAAGCGCAACCCCGGAGTCCGGCCCAGGTACC<br>TCTACCGAACCGTCTGAGGGCAGCGCACCAGGTACCTCTGAAAGCGCAACT<br>CCTGAGTCTGGCCCAGGTAGCGAACCTGCTACCTCCGGCTCTGAGACTCCAG<br>GTACCTCTGAAAGCGCAACCCCGGAATCTGGTCCAGGTAGCGAACCTGCAA<br>CCTCTGGCTCTGAAACCCCAGGTACCTCTGAAAGCGCTACTCCTGAATCTGG<br>CCCAGGTACTTCTACTGAACCGTCCGAGGGCAGCGCACCAGGTAGCCCTGCT<br>GGCTCTCCAACCTCCACCGAAGAAGGTACCTCTGAAAGCGCAACCCCTGAA<br>TCCGGCCCAGGTAGCGAACCGGCAACCTCCGGTTCTGAAACCCCAGGTACTT<br>CTGAAAGCGCTACTCCTGAGTCCGGCCCAGGTAGCCCGGCTGGCTCTCCGAC<br>TTCCACCGAGGAAGGTAGCCCGGCTGGCTCTCCAACTTCTACTGAAGAAGGT<br>ACTTCTACCGAACCTTCCGAGGGCAGCGCACCAGGTACTTCTGAAAGCGCTA<br>CCCCTGAGTCCGGCCCAGGTACTTCTGAAAGCGCTACTCCTGAATCCGGTCC<br>AGGTACTTCTGAAAGCGCTACCCCGGAATCTGGCCCAGGTAGCGAACCGGC<br>TACTTCTGGTTCTGAAACCCCAGGTAGCGAACCGGCTACCTCCGGTTCTGAA<br>ACTCCAGGTAGCCCAGCAGGCTCTCCGACTTCCACTGAGGAAGGTACTTCTA<br>CTGAACCTTCCGAAGGCAGCGCACCAGGTACCTCTACTGAACCTTCTGAGGG<br>CAGCGCTCCAGGTAGCGAACCTGCAACCTCTGGCTCTGAAACCCCAGGTAC<br>CTCTGAAAGCGCTACTCCTGAATCTGGCCCAGGTACTTCTACTGAACCGTCC<br>GAGGGCAGCGCACCA |
| AF864 | 117 | GGTTCTACCAGCGAATCTCCTTCTGGCACCGCTCCAGGTACCTCTCCTAGCG<br>GCGAATCTTCTACCGCTCCAGGTTCTACTAGCGAATCTCCTTCTGGCACTGC<br>ACCAGGTTCTACTAGCGAATCCCCGTCTGGTACTGCTCCAGGTACTTCTACT<br>CCTGAAAGCGGTTCCGCTTCTCCAGGTACCTCTACTCCGGAAAGCGGTTCTG<br>CATCTCCAGGTTCTACCAGCGAATCTCCTTCTGGCACCGCTCCAGGTTCTACT<br>AGCGAATCCCCGTCTGGTACCGCACCAGGTACTTCTCCTAGCGGCGAATCTT<br>CTACCGCACCAGGTTCTACTAGCGAATCTCCGTCTGGCACTGCTCCAGGTAC<br>TTCTCCTAGCGGTGAATCTTCTACCGCTCCAGGTACTTCCCCTAGCGGCGAA<br>TCTTCTACCGCTCCAGGTTCTACTAGCTCTACTGCAGAATCTCCGGGCCCAG<br>GTACCTCTCCTAGCGGTGAATCTTCTACCGCTCCAGGTACTTCTCCGAGCGG<br>TGAATCTTCTACCGCTCCAGGTTCTACTAGCTCTACTGCAGAATCTCCTGGCC<br>CAGGTACCTCTACTCCGGAAAGCGGCTCTGCATCTCCAGGTACTTCTACCCC<br>TGAAAGCGGTTCTGCATCTCCAGGTTCTACTAGCGAATCTCCTTCTGGCACT<br>GCACCAGGTTCTACCAGCGAATCTCCGTCTGGCACTGCACCAGGTACCTCTA<br>CCCCTGAAAGCGGTTCCGCTTCTCCAGGTTCTACCAGCTCTACCGCAGAATC<br>TCCTGGTCCAGGTACCTCTACTCCGGAAAGCGGCTCTGCATCTCCAGGTTCT<br>ACTAGCGAATCTCCTTCTGGCACTGCACCAGGTACTTCTCCGAGCGGTGAAT<br>CTTCTACCGCACCAGGTTCTACTAGCTCTACCGCTGAATCTCCGGGCCCAGG<br>TACTTCTCCGAGCGGTGAATCTTCTACTGCTCCAGGTACCTCTACTCCTGAA<br>AGCGGTTCTGCATCTCCAGGTTCCACTAGCTCTACCGCAGAATCTCCGGGCC |

TABLE 7-continued

DNA sequences of XTEN and precursor sequences

| XTEN Name | SEQ ID NO: | DNA Nucleotide Sequence |
|---|---|---|
| | | CAGGTTCTACTAGCTCTACTGCTGAATCTCCTGGCCCAGGTTCTACTAGCTCT<br>ACTGCTGAATCTCCGGGTCCAGGTTCTACCAGCTCTACTGCTGAATCTCCTG<br>GTCCAGGTACCTCCCCGAGCGGTGAATCTTCTACTGCACCAGGTTCTACTAG<br>CGAATCTCCTTCTGGCACTGCACCAGGTTCTACCAGCGAATCTCCGTCTGGC<br>ACTGCACCAGGTACCTCTACCCCTGAAAGCGGTCCXXXXXXXXXXXXXTGCA<br>AGCGCAAGCGGCGCGCCAAGCACGGGAXXXXXXXXXTAGCGAATCTCCTTCT<br>GGTACCGCTCCAGGTTCTACCAGCGAATCCCCGTCTGGTACTGCTCCAGGTT<br>CTACCAGCGAATCTCCTTCTGGTACTGCACCAGGTTCTACTAGCGAATCTCC<br>TTCTGGTACCGCTCCAGGTTCTACCAGCGAATCCCCGTCTGGTACTGCTCCA<br>GGTTCTACCAGCGAATCTCCTTCTGGTACTGCACCAGGTACTTCTACTCCGG<br>AAAGCGGTTCCGCATCTCCAGGTACTTCTCCTAGCGGTGAATCTTCTACTGC<br>TCCAGGTACCTCTCCTAGCGGCGAATCTTCTACTGCTCCAGGTTCTACCAGC<br>TCTACTGCTGAATCTCCGGGTCCAGGTACTTCCCCGAGCGGTGAATCTTCTA<br>CTGCACCAGGTACTTCTACTCCGGAAAGCGGTTCCGCTTCTCCAGGTTCTAC<br>CAGCGAATCTCCTTCTGGCACCGCTCCAGGTTCTACTAGCGAATCCCCGTCT<br>GGTACCGCACCAGGTACTTCTCCTAGCGGCGAATCTTCTACCGCACCAGGTT<br>CTACTAGCGAATCCCCGTCTGGTACCGCACCAGGTACTTCTACCCCGGAAAG<br>CGGCTCTGCTTCTCCAGGTACTTCTACCCCGGAAAGCGGCTCCGCATCTCCA<br>GGTTCTACTAGCGAATCTCCTTCTGGTACCGCTCCAGGTACTTCTACCCCTGA<br>AAGCGGCTCCGCTTCTCCAGGTTCCACTAGCTCTACCGCTGAATCTCCGGGT<br>CCAGGTTCTACCAGCGAATCTCCTTCTGGCACCGCTCCAGGTTCTACTAGCG<br>AATCCCCGTCTGGTACCGCACCAGGTACTTCTCCTAGCGGCGAATCTTCTAC<br>CGCACCAGGTTCTACCAGCTCTACTGCTGAATCTCCGGGTCCAGGTACTTCC<br>CCGAGCGGTGAATCTTCTACTGCACCAGGTACTTCTACTCCGGAAAGCGGTT<br>CCGCTTCTCCAGGTACCTCCCCTAGCGGCGAATCTTCTACTGCTCCAGGTAC<br>CTCTCCTAGCGGCGAATCTTCTACCGCTCCAGGTACCTCCCCTAGCGGTGAA<br>TCTTCTACCGCACCAGGTTCTACTAGCTCTACTGCTGAATCTCCGGGTCCAG<br>GTTCTACCAGCTCTACTGCTGAATCTCCTGGTCCAGGTACCTCCCCGAGCGG<br>TGAATCTTCTACTGCACCAGGTTCTAGCCCTTCTGCTTCCACCGGTACCGGCC<br>CAGGTAGCTCTACTCCGTCTGGTGCAACTGGCTCTCCAGGTAGCTCTACTCC<br>GTCTGGTGCAACCGGCTCCCCA<br>XXXX was inserted in two areas where no sequence information is available. |
| AG864 | 118 | GGTGCTTCCCCGGGCACCAGCTCTACTGGTTCTCCAGGTTCTAGCCCGTCTG<br>CTTCTACTGGTACTGGTCCAGGTTCTAGCCCTTCTGCTTCCACTGGTACTGGT<br>CCAGGTACCCCGGGTAGCGGTACCGCTTCTTCTTCTCCAGGTAGCTCTACTC<br>CGTCTGGTGCTACCGGCTCTCCAGGTTCTAACCCTTCTGCATCCACCGGTAC<br>CGGCCCAGGTGCTTCTCCGGGCACCAGCTCTACTGGTTCTCCAGGTACCCCG<br>GGCAGCGGTACCGCATCTTCTTCTCCAGGTAGCTCTACTCCTTCTGGTGCAA<br>CTGGTTCTCCAGGTACTCCTGGCAGCGGTACCGCTTCTTCTTCTCCAGGTGCT<br>TCTCCTGGTACTAGCTCTACTGGTTCTCCAGGTGCTTCTCCGGGCACTAGCTC<br>TACTGGTTCTCCAGGTACCCCGGGTAGCGGTACTGCTTCTTCCTCTCCAGGT<br>AGCTCTACCCCTTCTGGTGCAACCGGCTCTCCAGGTGCTTCTCCGGGCACCA<br>GCTCTACCGGTTCTCCAGGTACCCCGGGTAGCGGTACCGCTTCTTCTTCTCCA<br>GGTAGCTCTACTCCGTCTGGTGCTACCGGCTCTCCAGGTTCTAACCCTTCTGC<br>ATCCACCGGTACCGGCCCAGGTTCTAGCCCTTCTGCTTCCACCGGTACTGGC<br>CCAGGTAGCTCTACCCCTTCTGGTGCTACCGGCTCCCCAGGTAGCTCTACTC<br>CTTCTGGTGCAACTGGCTCTCCAGGTGCATCTCCGGGCACTAGCTCTACTGG<br>TTCTCCAGGTGCATCCCCTGGCACTAGCTCTACTGGTTCTCCAGGTGCTTCTC<br>CTGGTACCAGCTCTACTGGTTCTCCAGGTACTCCTGGCAGCGGTACCGCTTC<br>TTCTTCTCCAGGTGCTTCTCCTGGTACTAGCTCTACTGGTTCTCCAGGTGCTT<br>CTCCGGGCACTAGCTCTACTGGTTCTCCAGGTGCTTCCCCGGGCACTAGCTC<br>TACCGGTTCTCCAGGTTCTAGCCCTTCTGCATCTACTGGTACTGGCCCAGGT<br>ACTCCGGGCAGCGGTACTGCTTCTTCCTCTCCAGGTGCATCTCCGGGCACTA<br>GCTCTACTGGTTCTCCAGGTGCATCCCCTGGCACTAGCTCTACTGGTTCTCCA<br>GGTGCTTCTCCTGGTACCAGCTCTACTGGTTCTCCAGGTAGCTCTACTCCGTC<br>TGGTGCAACCGGTTCCCCAGGTAGCTCTACTCCTTCTGGTGCTACTGGCTCC<br>CCAGGTGCATCCCCTGGCACCAGCTCTACCGGTTCTCCAGGTACCCCGGGCA<br>GCGGTACCGCATCTTCCTCTCCAGGTAGCTCTACCCCGTCTGGTGCTACCGG<br>TTCCCCAGGTAGCTCTACCCCGTCTGGTGCAACCGGCTCCCCAGGTAGCTCT<br>ACTCCGTCTGGTGCAACCGGCTCCCCAGGTTCTAGCCCGTCTGCTTCCACTG<br>GTACTGGCCCAGGTGCTTCCCGGGCACCAGCTCTACTGGTTCTCCAGGTGC<br>ATCCCCGGGTACCAGCTCTACCGGTTCTCCAGGTACTCCTGGCAGCGGTACT<br>GCATCTTCCTCTCCAGGTGCTTCTCCGGGCACCAGCTCTACTGGTTCTCCAGG<br>TGCATCTCCGGGCACTAGCTCTACTGGTTCTCCAGGTGCATCCCCTGGCACT<br>AGCTCTACTGGTTCTCCAGGTGCTTCTCCTGGTACCAGCTCTACTGGTTCTCC<br>AGGTACCCCTGGTAGCGGTACTGCTTCTTCCTCTCCAGGTAGCTCTACTCCGT<br>CTGGTGCTACCGGTTCTCCAGGTACCCCGGGTAGCGGTACCGCATCTTCTTC<br>TCCAGGTAGCTCTACCCCGTCTGGTGCTACTGGTTCTCCAGGTACTCCGGGC<br>AGCGGTACTGCTTCTTCCTCTCCAGGTAGCTCTACCCCTTCTGGTGCTACTGG<br>CTCTCCAGGTAGCTCTACCCCGTCTGGTGCTACTGGCTCCCAGGTTCTAGC<br>CCTTCTGCATCCACCGGTACCGGTCCAGGTTCTAGCCCGTCTGCATCTACTG<br>GTACTGGTCCAGGTGCATCCCCGGGCACTAGCTCTACCGGTTCTCCAGGTAC<br>TCCTGGTAGCGGTACTGCTTCTTCTTCTCCAGGTAGCTCTACTCCTTCTGGTG<br>CTACTGGTTCTCCAGGTTCTAGCCCTTCTGCATCCACCGGTACCGGCCCAGG |

TABLE 7-continued

DNA sequences of XTEN and precursor sequences

| XTEN Name | SEQ ID NO: | DNA Nucleotide Sequence |
|---|---|---|
| | | TTCTAGCCCGTCTGCTTCTACCGGTACTGGTCCAGGTGCTTCTCCGGGTACTA<br>GCTCTACTGGTTCTCCAGGTGCATCTCCTGGTACTAGCTCTACTGGTTCTCCA<br>GGTAGCTCTACTCCGTCTGGTGCAACCGGCTCTCCAGGTTCTAGCCCTTCTG<br>CATCTACCGGTACTGGTCCAGGTGCATCCCCTGGTACCAGCTCTACCGGTTC<br>TCCAGGTTCTAGCCCTTCTGCTTCTACCGGTACCGGTCCAGGTACCCCTGGC<br>AGCGGTACCGCATCTTCCTCTCCAGGTAGCTCTACTCCGTCTGGTGCAACCG<br>GTTCCCCAGGTAGCTCTACTCCTTCTGGTGCTACTGGCTCCCCAGGTGCATCC<br>CCTGGCACCAGCTCTACCGGTTCTCCA |
| AM923 | 119 | ATGGCTGAACCTGCTGGCTCTCCAACCTCCACTGAGGAAGGTGCATCCCCGG<br>GCACCAGCTCTACCGGTTCTCCAGGTAGCTCTACCCCGTCTGGTGCTACCGG<br>CTCTCCAGGTAGCTCTACCCCGTCTGGTGCTACTGGCTCTCCAGGTACTTCTA<br>CTGAACCGTCTGAAGGCAGCGCACCAGGTAGCGAACCGGCTACTTCCGGTT<br>CTGAAACCCCAGGTAGCCCAGCAGGTTCTCCAACTTCTACTGAAGAAGGTTC<br>TACCAGCTCTACCGCAGAATCTCCTGGTCCAGGTACCTCTACTCCGGAAAGC<br>GGCTCTGCATCTCCAGGTTCTACTAGCGAATCTCCTTCTGGCACTGCACCAG<br>GTTCTACTAGCGAATCCCCGTCTGGTACTGCTCCAGGTACTTCTACTCCTGA<br>AAGCGGTTCCGCTTCTCCAGGTACCTCTACTCCGGAAAGCGGTTCTGCATCT<br>CCAGGTAGCGAACCGGCAACCTCCGGCTCTGAAACCCCAGGTACCTCTGAA<br>AGCGCTACTCCTGAATCCGGCCCAGGTAGCCCGGCAGGTTCTCCGACTTCCA<br>CTGAGGAAGGTACCTCTACTGAACCTTCTGAGGGCAGCGCTCCAGGTACTTC<br>TGAAAGCGCTACCCCGGAGTCCGGTCCAGGTACTTCTACTGAACCGTCCGAA<br>GGTAGCGCACCAGGTACTTCTACCGAACCGTCCGAGGGTAGCGCACCAGGT<br>AGCCCAGCAGGTTCTCCTACCTCCACCGAGGAAGGTACTTCTACCGAACCGT<br>CCGAGGGTAGCGCACCAGGTACTTCTACCGAACCTTCCGAGGGCAGCGCAC<br>CAGGTACTTCTGAAAGCGCTACCCCTGAGTCCGGCCCAGGTACTTCTGAAAG<br>CGCTACTCCTGAATCCGGTCCAGGTACCTCTACTGAACCTTCCGAAGGCAGC<br>GCTCCAGGTACCTCTACCGAACCGTCCGAGGGCAGCGCACCAGGTACTTCTG<br>AAAGCGCAACCCCTGAATCCGGTCCAGGTACTTCTACTGAACCTTCCGAAGG<br>TAGCGCTCAGGTAGCGAACCTGCTACTTCTGGTTCTGAAACCCCAGGTAGC<br>CCGGCTGGCTCTCCGACCTCCACCGAGGAAGGTAGCTCTACCCCGTCTGGTG<br>CTACTGGTTCTCCAGGTACTCCGGGCAGCGGTACTGCTTCTTCCTCTCCAGGT<br>AGCTCTACCCCTTCTGGTGCTACTGGCTCTCCAGGTACCTCTACCGAACCGT<br>CCGAGGGTAGCGCACCAGGTACCTCTACTGAACCGTCTGAGGGTAGCGCTC<br>CAGGTAGCGAACCGGCAACCTCCGGTTCTGAAACTCCAGGTAGCCCTGCTG<br>GCTCTCCGACTTCTACTGAGGAAGGTAGCCCGGCTGGTTCTCCGACTTCTAC<br>TGAGGAAGGTACTTCTACCGAACCTTCCGAAGGTAGCGCTCCAGGTGCAAG<br>CGCAAGCGGCGCGCCAAGCACGGGAGGTACTTCTGAAAGCGCTACTCCTGA<br>GTCCGGCCCAGGTAGCCCGGCTGGCTCTCCGACTTCCACCGAGGAAGGTAG<br>CCCGGCTGGCTCTCCAACTTCTACTGAAGAAGGTTCTACCAGCTCTACCGCT<br>GAATCTCCTGGCCAGGTTCTACTAGCGAATCTCCGTCTGGCACCGCACCAG<br>GTACTTCCCCTAGCGGTGAATCTTCTACTGCACCAGGTACCCCTGGCAGCGG<br>TACCGCTTCTTCCTCTCCAGGTAGCTCTACCCCGTCTGGTGCTACTGGCTCTC<br>CAGGTTCTAGCCCGTCTGCATCTACCGGTACCGGCCCAGGTAGCGAACCGGC<br>AACCTCCGGCTCTGAAACTCCAGGTACTTCTGAAAGCGCTACTCCGGAATCC<br>GGCCCAGGTAGCGAACCGGCTACTTCCGGCTCTGAAACCCCAGGTTCCACC<br>AGCTCTACTGCAGAATCTCCGGGCCCAGGTTCTACTAGCTCTACTGCAGAAT<br>CTCCGGGTCCAGGTACTTCTCCTAGCGGCGAATCTTCTACCGCTCCAGGTAG<br>CGAACCGGCAACCTCTGGCTCTGAAACTCCAGGTAGCGAACCTGCAACCTC<br>CGGCTCTGAAACCCCAGGTACTTCTACTGAACCTTCTGAGGGCAGCGCACCA<br>GGTTCTACCAGCTCTACCGCAGAATCTCCTGGTCCAGGTACCTCTACTCCGG<br>AAAGCGGCTCTGCATCTCCAGGTTCTACTAGCGAATCTCCTTCTGGCACTGC<br>ACCAGGTACTTCTACCGAACCGTCCGAAGGCAGCGCTCCAGGTACCTCTACT<br>GAACCTTCCGAGGGCAGCGCTCCAGGTACCTCTACCGAACCTTCTGAAGGTA<br>GCGCACCAGGTAGCTACTCCGTCTGGTGCAACCGGCTCCCCAGGTTCTAG<br>CCCGTCTGCTTCCACTGGTACTGGCCCAGGTGCTTCCCGGGCACCAGCTCT<br>ACTGGTTCTCCAGGTAGCGAACCTGCTACCTCCGGTTCTGAAACCCCAGGTA<br>CCTCTGAAAGCGCAACTCCGGAGTCGGTCCAGGTAGCCCTGCAGGTTCTCC<br>TACCTCCACTGAGGAAGGTAGCTCTACTCCGTCTGGTGCAACCGGCTCCCCA<br>GGTTCTAGCCCGTCTGCTTCCACTGGTACTGGCCCAGGTGCTTCCCGGGCA<br>CCAGCTCTACTGGTTCTCCAGGTACCTCTGAAAGCGCTACTCCGGAGTCTGG<br>CCCAGGTACCTCTACTGAACCGTCTGAGGGTAGCGCTCCAGGTACTTCTACT<br>GAACCGTCCGAAGGTAGCGCACCA |
| AE912 | 120 | ATGGCTGAACCTGCTGGCTCTCCAACCTCCACTGAGGAAGGTACCCCGGGTA<br>GCGGTACTGCTTCTTCCTCTCCAGGTAGCTCTACCCCTTCTGGTGCAACCGGC<br>TCTCCAGGTGCTTCTCCGGGCACCAGCTCTACCGGTTCTCCAGGTAGCCCGG<br>CTGGCTCTCCTACCTCTACTGAGGAAGGTACTTCTGAAAGCGCTACTCCTGA<br>GTCTGGTCCAGGTACCTCTACTGAACCGTCCGAAGGTAGCGCTCCAGGTAGC<br>CCAGCAGGCTCTCCGACTTCCACTGAGGAAGGTACTTCTACTGAACCTTCCG<br>AAGGCAGCGCACCAGGTACCTCTACTGAACCTTCTGAGGGCAGCGCTCCAG<br>GTACTTCTGAAAGCGCTACCCCGGAATCTGGCCCAGGTAGCGAACCGGCTA<br>CTTCTGGTTCTGAAACCCCAGGTAGCGAACCGGCTACCTCCGGTTCTGAAAC<br>TCCAGGTAGCCCGGCAGGCTCTCCGACCTCTACTGAGGAAGGTACTTCTGAA<br>AGCGCAACCCCGGAGTCCGGCCCAGGTACCTCTACCGAACCGTCTGAGGGC |

TABLE 7-continued

DNA sequences of XTEN and precursor sequences

| XTEN Name | SEQ ID NO: | DNA Nucleotide Sequence |
|---|---|---|
| | | AGCGCACCAGGTACTTCTACCGAACCGTCCGAGGGTAGCGCACCAGGTAGC
CCAGCAGGTTCTCCTACCTCCACCGAGGAAGGTACTTCTACCGAACCGTCCG
AGGGTAGCGCACCAGGTACCTCTACTGAACCTTCTGAGGGCAGCGCTCCAG
GTACTTCTGAAAGCGCTACCCCGGAGTCCGGTCCAGGTACTTCTACTGAACC
GTCCGAAGGTAGCGCACCAGGTACTTCTGAAAGCGCAACCCCTGAATCCGG
TCCAGGTAGCGAACCGGCTACTTCTGGCTCTGAGACTCCAGGTACTTCTACC
GAACCGTCCGAAGGTAGCGCACCAGGTACTTCTACTGAACCGTCTGAAGGT
AGCGCACCAGGTACTTCTGAAAGCGCAACCCCGGAATCCGGCCCAGGTACC
TCTGAAAGCGCAACCCCGGAGTCCGGCCCAGGTAGCCCTGCTGGCTCTCCA
ACCTCCACCGAAGAAGGTACCTCTGAAAGCGCAACCCCTGAATCCGGCCCA
GGTAGCGAACCGGCAACCTCCGGTTCTGAAACCCCAGGTACCTCTGAAAGC
GCTACTCCGGAGTCTGGCCCAGGTACCTCTACTGAACCGTCTGAGGGTAGCG
CTCCAGGTACTTCTACTGAACCGTCCGAAGGTAGCGCACCAGGTACTTCTAC
CGAACCGTCCGAAGGCAGCGCTCCAGGTACCTCTACTGAACCTTCCGAGGG
CAGCGCTCCAGGTACCTCTACCGAACCTTCTGAAGGTAGCGCACCAGGTACT
TCTACCGAACCGTCCGAGGGTAGCGCACCAGGTAGCCCAGCAGGTTCTCCT
ACCTCCACCGAGGAAGGTACTTCTACCGAACCGTCCGAGGGTAGCGCACCA
GGTACCTCTGAAAGCGCAACTCCTGAGTCTGGCCCAGGTAGCGAACCTGCT
ACCTCCGGCTCTGAGACTCCAGGTACCTCTGAAAGCGCAACCCCGGAATCTG
GTCCAGGTAGCGAACCTGCAACCTCTGGCTCTGAAACCCCAGGTACCTCTGA
AAGCGCTACTCCTGAATCTGGCCCAGGTACTTCTACTGAACCGTCCGAGGGC
AGCGCACCAGGTACTTCTGAAAGCGCTACTCCTGAGTCCGGCCCAGGTAGC
CCGGCTGGCTCTCCGACTTCCACCGAGGAAGGTAGCCCGGCTGGCTCTCCAA
CTTCTACTGAAGAAGGTAGCCCGGCAGGCTCTCCGACCTTCTACTGAGGAAG
GTACTTCTGAAAGCGCAACCCCGGAGTCCGGCCCAGGTACCTCTACCGAAC
CGTCTGAGGGCAGCGCACCAGGTACCTCTGAAAGCGCAACTCCTGAGTCTG
GCCCAGGTAGCGAACCTGCTACCTCCGGCTCTGAGACTCCAGGTACCTCTGA
AAGCGCAACCCCGGAATCTGGTCAGGTAGCGAACCTGCAACCTCTGGCTC
TGAAACCCCAGGTACCTCTGAAAGCGCTACTCCTGAATCTGGCCCAGGTACT
TCTACTGAACCGTCCGAGGGCAGCGCACCAGGTAGCCCTGCTGGCTCTCCAA
CCTCCACCGAAGAAGGTACCTCTGAAAGCGCAACCCCTGAATCCGGCCCAG
GTAGCGAACCGGCAACCTCCGGTTCTGAAACCCCAGGTACTTCTGAAAGCG
CTACTCCTGAGTCCGGCCCAGGTAGCCCGGCTGGCTCTCCGACTTCCACCGA
GGAAGGTAGCCCGGCTGGCTCTCCAACTTCTACTGAAGAAGGTACTTCTACC
GAACCTTCCGAGGGCAGCGCACCAGGTACTTCTGAAAGCGCTACCCCTGAG
TCCGGCCCAGGTACTTCTGAAAGCGCTACTCCTGAATCCGGTCCAGGTACTT
CTGAAAGCGCTACCCCGGAATCTGGCCCAGGTAGCGAACCGGCTACTTCTG
GTTCTGAAACCCCAGGTAGCGAACCGGCTACCTCCGGTTCTGAAACTCCAGG
TAGCCCAGCAGGCTCTCCGACTTCCACTGAGGAAGGTACTTCTACTGAACCT
TCCGAAGGCAGCGCACCAGGTACCTCTACTGAACCTTCTGAGGGCAGCGCT
CCAGGTAGCGAACCTGCAACCTCTGGCTCTGAAACCCCAGGTACCTCTGAA
AGCGCTACTCCTGAATCTGGCCCAGGTACTTCTACTGAACCGTCCGAGGGCA
GCGCACCA |
| AM1318 | 121 | GGTACTTCTACTGAACCGTCTGAAGGCAGCGCACCAGGTAGCGAACCGGCT
ACTTCCGGTTCTGAAACCCCAGGTAGCCCAGCAGGTTCTCCAACTTCTACTG
AAGAAGGTTCTACCAGCTCTACCGCAGAATCTCCTGGTCCAGGTACCTCTAC
TCCGGAAAGCGGCTCTGCATCTCCAGGTTCTACTAGCGAATCTCCTTCTGGC
ACTGCACCAGGTTCTACTAGCGAATCCCGTCTGGTACTGCTCCAGGTACTT
CTACTCCTGAAAGCGGTTCCGCTTCTCCAGGTACCTCTACTCCGGAAAGCGG
TTCTGCATCTCCAGGTAGCGAACCGGCAACCTCCGGCTCTGAAACCCCAGGT
ACCTCTGAAAGCGCTACTCCTGAATCCGGCCCAGGTAGCCCGGCAGGTTCTC
CGACTTCCACTGAGGAAGGTACCTCTACTGAACCTTTCTGAGGGCAGCGCTCC
AGGTACTTCTGAAAGCGCTACCCCGGAGTCCGGTCAGGTACTTCTACTGAA
CCGTCCGAAGGTAGCGCACCAGGTACTTCTACCGAACCGTCCGAGGGTAGC
GCACCAGGTAGCCCAGCAGGTTCTCCTACCTCCACCGAGGAAGGTACTTCTA
CCGAACCGTCCGAGGGTAGCGCACCAGGTACTTCTACCGAACCTTCCGAGG
GCAGCGCACCAGGTACTTCTGAAAGCGCTACCCCTGAGTCCGGCCCAGGTA
CTTCTGAAAGCGCTACTCCTGAATCCGGTCCAGGTACCTCTACTGAACCTTC
CGAAGGCAGCGCTCCAGGTACCTCTACCGAACCGTCCGAGGGCAGCGCACC
AGGTACTTCTGAAAGCGCAACCCCTGAATCCGGTCCAGGTACTTCTACTGAA
CCTTCCGAAGGTAGCGCTCCAGGTAGCGAACCTGCTACTTCTGGTTCTGAAA
CCCCAGGTAGCCCGGCTGGCTCTCCGACCTCCACCGAGGAAGGTAGCTCTAC
CCCGTCTGGTGCTACTGGTTCTCCAGGTACTCCGGGCAGCGGTACTGCTTCT
TCCTCTCCAGGTAGCTCTACCCCTTCTGGTGCTACTGGCTCTCCAGGTACCTC
TACCGAACCGTCCGAGGGTAGCGCACCAGGTACCTCTACTGAACCGTCTGA
GGGTAGCGCTCCAGGTAGCGAACCGGCAACCTCCGGTTCTGAAACTCCAGG
TAGCCCTGCTGGCTCTCCGACTTCTACTGAGGAAGGTAGCCCGGCTGGTTCT
CCGACTTCTACTGAGGAAGGTACTTCTACCGAACCTTCCGAAGGTAGCGCTC
CAGGTCCAGAACCAACGGGACCGGCCCCAAGCGGAGGTAGCGAACCGGCA
ACCTCCGGCTCTGAAACCCCAGGTACCTCTGAAAGCGCTACTCCTGAATCCG
GCCCAGGTAGCCCGGCAGGTTCTCCGACTTCCACTGAGGAAGGTACTTCTGA
AAGCGCTACTCCTGAGTCCGGCCCAGGTAGCCCGGCTGGCTCTCCGACTTCC
ACCGAGGAAGGTAGCCCGGCTGGCTCTCCAACTTCTACTGAAGAAGGTACT
TCTGAAAGCGCTACTCCTGAGTCCGGCCCAGGTAGCCCGGCTGGCTCTCCGA |

TABLE 7-continued

DNA sequences of XTEN and precursor sequences

| XTEN Name | SEQ ID NO: | DNA Nucleotide Sequence |
|---|---|---|
| | | CTTCCACCGAGGAAGGTAGCCCGGCTGGCTCTCCAACTTCTACTGAAGAAG GTTCTACCAGCTCTACCGCTGAATCTCCTGGCCCAGGTTCTACTAGCGAATC TCCGTCTGGCACCGCACCAGGTACTTCCCCTAGCGGTGAATCTTCTACTGCA CCAGGTTCTACCAGCGAATCTCCTTCTGGCACCGCTCCAGGTTCTACTAGCG AATCCCGTCTGGTACCGCACCAGGTACTTCTCCTAGCGGCGAATCTTCTAC CGCACCAGGTACTTCTACCGAACCTTCCGAGGGCAGCGCACCAGGTACTTCT GAAAGCGCTACCCCTGAGTCCGGCCCAGGTACTTCTGAAAGCGCTACTCCTG AATCCGGTCCAGGTAGCGAACCGGCAACCTCTGGCTCTGAAACCCCAGGTA CCTCTGAAAGCGCTACTCCGGAATCTGGTCCAGGTACTTCTGAAAGCGCTAC TCCGGAATCCGGTCCAGGTACCTCTACTGAACCTTCTGAGGGCAGCGCTCCA GGTACTTCTGAAAGCGCTACCCCGGAGTCCGGTCCAGGTACTTCTACTGAAC CGTCCGAAGGTAGCGCACCAGGTACCTCCCCTAGCGGCGAATCTTCTACTGC TCCAGGTACCTCTCCTAGCGGCGAATCTTCTACCGCTCCAGGTACCTCCCCT AGCGGTGAATCTTCTACCGCACCAGGTACTTCTACCGAACCGTCCGAGGGTA GCGCACCAGGTAGCCCAGCAGGTTCTCCTACCTCCACCGAGGAAGGTACTTC TACCGAACCGTCCGAGGGTAGCGCACCAGGTTCTAGCCCTTCTGCTTCCACC GGTACCGGCCCAGGTAGCTCTACTCCGTCTGGTGCAACTGGCTCTCCAGGTA GCTCTACTCCGTCTGGTGCAACCGGCTCCCCAGGTAGCTCTACCCCGTCTGG TGCTACCGGCTCTCCAGGTAGCTCTACCCCGTCTGGTGCAACCGGCTCCCCA GGTGCATCCCGGGTACTAGCTCTACCGGTTCTCCAGGTGCAAGCGCAAGCG GCGCGCCAAGCACGGGAGGTACTTCTCCGAGCGGTGAATCTTCTACCGCAC CAGGTTCTACTAGCTCTACCGCTGAATCTCCGGGCCCAGGTACTTCTCCGAG CGGTGAATCTTCTACTGCTCCAGGTACCTCTGAAAGCGCTACTCCGGAGTCT GGCCCAGGTACCTCTACTGAACCGTCTGAGGGTAGCGCTCCAGGTACTTCTA CTGAACCGTCCGAAGGTAGCGCACCAGGTTCTAGCCCTTCTGCATCTACTGG TACTGGCCCAGGTAGCTCTACTCCTTCTGGTGCTACCGGCTCTCCAGGTGCTT CTCCGGGTACTAGCTCTACCGGTTCTCCAGGTACTTCTACTCCGGAAAGCGG TTCCGCATCTCCAGGTACTTCTCCTAGCGGTGAATCTTCTACTGCTCCAGGTA CCTCTCCTAGCGGCGAATCTTCTACTGCTCCAGGTACTTCTGAAAGCGCAAC CCCTGAATCCGGTCCAGGTAGCGAACCGGCTACTTCGGCTCTGAGACTCCA GGTACTTCTACCGAACCGTCCGAAGGTAGCGCACCAGGTTCTACCAGCGAA TCCCCTTCTGGTACTGCTCCAGGTTCTACCAGCGAATCCCCTTCTGGCACCGC ACCAGGTACTTCTACCCCTGAAAGCGGCTCCGCTTCTCCAGGTAGCCCGGCA GGCTCTCCGACCTCTACTGAGGAAGGTACTTCTGAAAGCGCAACCCCCGGAG TCCGGCCCAGGTACCTCTACCGAACCGTCTGAGGGCAGCGCACCAGGTAGC CCTGCTGGCTCTCCAACCTCCACCGAAGAAGGTACCTCTGAAAGCGCAACCC CTGAATCCGGCCCAGGTAGCGAACCGGCAACCTCCGGTTCTGAAACCCCAG GTAGCTCTACCCCGTCTGGTGCTACCGGTTCCCCAGGTGCTTCTCCTGGTACT AGCTCTACCGGTTCTCCAGGTAGCTCTACCCCGTCTGGTGCTACTGGCTCTCC AGGTTCTACTAGCGAATCCCCGTCTGGTACTGCTCCAGGTACTTCCCCTAGC GGTGAATCTTCTACTGCTCCAGGTTCTACCAGCTCTACCGCAGAATCTCCGG GTCCAGGTAGCTCTACCCCTTCTGGTGCAACCGGCTCTCCAGGTGCATCCCC GGGTACCAGCTCTACCGGTTCTCCAGGTACTCCGGGTAGCGGTACCGCTTCT TCCTCTCCAGGTAGCCCTGCTGGCTCTCCGACTTCTACTGAGGAAGGTAGCC CGGCTGGTTCTCCGACTTCTACTGAGGAAGGTACTTCTACCGAACCTTCCGA AGGTAGCGCTCCA |
| BC864 | 122 | GGTACTTCCACCGAACCATCCGAACCAGGTAGCGCAGGTACTTCCACCGAA CCATCCGAACCTGGCAGCGCAGGTAGCGAACCGGCAACCTCTGGTACTGAA CCATCAGGTAGCGGCGCATCCGAGCCTACCTCTACTGAACCAGGTAGCGAA CCGGCTACCTCCGGTACTGAGCCATCAGGTAGCGAACCGGCAACTTCCGGT ACTGAACCATCAGGTAGCGAACCGGCAACTTCCGGCACTGAACCATCAGGT AGCGGTGCATCTGAGCCGACCTCTACTGAACCAGGTACTTCTACTGAACCAT CTGAGCCGGGCAGCGCAGGTAGCGAACCAGCTACTTCTGGCACTGAACCAT CAGGTACTTCTACTGAACCATCCGAACCAGGTAGCGCAGGTAGCGAACCTG CTACCTCTGGTACTGAGCCATCAGGTAGCGAACCGGCTACCTCTGGTACTGA ACCATCAGGTACTTCTACCGAACCATCCGAGCCTGGTAGCGCAGGTACTTCT ACCGAACCATCCGAGCCAGGTAGCGCAGGTAGCGAACCGGCAACCTCTGGC ACTGAGCCATCAGGTAGCGAACCAGCAACTTCTGGTACTGAACCATCAGGT ACTAGCGAGCCATCTACTTCCGAACCAGGTGCAGGTAGCGGCGCATCCGAA CCTACTTCCACTGAACCAGGTACTAGCGAGCCATCCACCTCTGAACCAGGTG CAGGTAGCGAACCGGCAACTTCCGGCACTGAACCATCAGGTAGCGAACCGG CTACCTCTGGTACTGAACCATCAGGTACTTCTACCGAACCATCCGAGCCTGG TAGCGCAGGTACTTCTACCGAACCATCCGAGCCAGGCAGCGCAGGTAGCGG TGCATCCGAGCCGACCTCTACTGAACCAGGTAGCGAACCAGCAACTTCTGG CACTGAGCCATCAGGTAGCGAACCAGCTACCTCTGGTACTGAACCATCAGG TAGCGAACCGGCTACTTCCGGCACTGAACCATCAGGTAGCGAACCAGCAAC CTCCGGTACTGAACCATCAGGTACTTCCACTGAACCATCCGAACCGGGTAGC GCAGGTAGCGAACCGGCAACTTCCGGCACTGAACCATCAGGTAGCGGTGCA TCTGAGCCGACCTCTACTGAACCAGGTACTTCTACTGAACCATCTGAGCCGG GCAGCGCAGGTAGCGAACCTGCAACCTCCGGCACTGAGCCATCAGGTAGCG GCGCATCTGAACCAACCTCTACTGAACCAGGTACTTCCACCGAACCATCTGA GCCAGGCAGCGCAGGTAGCGGCGCATCTGAACCAACCTCTACTGAACCAGG TAGCGAACCAGCAACTTCTGGTACTGAACCATCAGGTAGCGGCGCATCTGA GCCTACTTCCACTGAACCAGGTAGCGAACCGGCAACTTCCGGCACTGAACC |

TABLE 7-continued

DNA sequences of XTEN and precursor sequences

| XTEN Name | SEQ ID NO: | DNA Nucleotide Sequence |
|---|---|---|
| | | ATCAGGTAGCGGTGCATCTGAGCCGACCTCTACTGAACCAGGTACTTCTACT<br>GAACCATCTGAGCCGGGCAGCGCAGGTAGCGAACCGGCAACTTCCGGCACT<br>GAACCATCAGGTAGCGGTGCATCTGAGCCGACCTCTACTGAACCAGGTACTT<br>CTACTGAACCATCTGAGCCGGGCAGCGCAGGTAGCGAACCAGCTACTTCTG<br>GCACTGAACCATCAGGTACTTCTACTGAACCATCCGAACCAGGTAGCGCAG<br>GTAGCGAACCTGCTACCTCTGGTACTGAGCCATCAGGTACTTCTACTGAACC<br>ATCCGAGCCGGGTAGCGCAGGTACTTCCACTGAACCATCTGAACCTGGTAG<br>CGCAGGTACTTCCACTGAACCATCCGAACCAGGTAGCGCAGGTACTTCTACT<br>GAACCATCCGAGCCGGGTAGCGCAGGTACTTCCACTGAACCATCTGAACCT<br>GGTAGCGCAGGTACTTCCACTGAACCATCCGAACCAGGTAGCGCAGGTACT<br>AGCGAACCATCCACCTCCGAACCAGGCGCAGGTAGCGGTGCATCTGAACCG<br>ACTTCTACTGAACCAGGTACTTCCACTGAACCATCTGAGCCAGGTAGCGCAG<br>GTACTTCCACCGAACCATCCGAACCAGGTAGCGCAGGTACTTCCACCGAAC<br>CATCCGAACCTGGCAGCGCAGGTAGCGAACCGGCAACCTCTGGTACTGAAC<br>CATCAGGTAGCGGTGCATCCGAGCCGACCTCTACTGAACCAGGTAGCGAAC<br>CAGCAACTTCTGGCACTGAGCCATCAGGTAGCGAACCGGCTACCTCTGGTAC<br>TGAACCATCAGGTAGCGAACCGGCAACCTCTGGCACTGAGCCATCAGGTAG<br>CGAACCAGCAACTTCTGGTACTGAACCATCAGGTACTAGCGAGCCATCTACT<br>TCCGAACCAGGTGCAGGTAGCGAACCTGCAACCTCCGGCACTGAGCCATCA<br>GGTAGCGGCGCATCTGAACCAACCTCTACTGAACCAGGTACTTCCACCGAA<br>CCATCTGAGCCAGGCAGCGCAGGTAGCGAACCTGCAACCTCCGGCACTGAG<br>CCATCAGGTAGCGGCGCATCTGAACCAACCTCTACTGAACCAGGTACTTCCA<br>CCGAACCATCTGAGCCAGGCAGCGCA |
| BD864 | 123 | GGTAGCGAAACTGCTACTTCCGGCTCTGAGACTGCAGGTACTAGTGAATCCG<br>CAACTAGCGAATCTGGCGCAGGTAGCACTGCAGGCTCTGAGACTTCCACTG<br>AAGCAGGTACTAGCGAGTCCGCAACCAGCGAATCCGGCGCAGGTAGCGAAA<br>CTGCTACCTCTGGCTCCGAGACTGCAGGTAGCGAAACTGCAACCTCTGGCTC<br>TGAAACTGCAGGTACTTCCACTGAAGCAAGTGAAGGCTCCGCATCAGGTAC<br>TTCCACCGAAGCAAGCGAAGGCTCCGCATCAGGTACTAGTGAGTCCGCAAC<br>TAGCGAATCCGGTGCAGGTAGCGAAACCGCTACCTCTGGTTCCGAAACTGC<br>AGGTACTTCTACCGAGGCTAGCGAAGGTTCTGCATCAGGTAGCACTGCTGGT<br>TCCGAGACTTCTACTGAAGCAGGTACTAGCGAATCTGCTACTAGCGAATCCG<br>GCGCAGGTACTAGCGAATCCGCTACCAGCGAATCCGGCGCAGGTAGCGAAA<br>CTGCAACCTCTGGTTCCGAGACTGCAGGTACTAGCGAGTCCGCTACTAGCGA<br>ATCTGGCGCAGGTACTTCCACTGAAGCTAGTGAAGGTTCTGCATCAGGTAGC<br>GAAACTGCTACTTCTGGTTCCGAAACTGCAGGTAGCGAAACCGCTACCTCTG<br>GTTCCGAAACTGCAGGTACTTCTACCGAGGCTAGCGAAGGTTCTGCATCAGG<br>TAGCACTGCTGGTTCCGAGACTTCTACTGAAGCAGGTACTAGCGAGTCCGCT<br>ACTAGCGAATCTGGCGCAGGTACTTCCACTGAAGCTAGTGAAGGTTCTGCAT<br>CAGGTAGCGAAACTGCTACTTCTGGTTCCGAAACTGCAGGTAGCACTGCTGG<br>CTCCGAGACTTCTACCGAAGCAGGTAGCACTGCAGGTTCCGAAACTTCCACT<br>GAAGCAGGTAGCGAAACTGCTACCTCTGGCTCTGAGACTGCAGGTACTAGC<br>GAATCTGCTACTAGCGAATCCGGCGCAGGTACTAGCGAATCCGCTACCAGC<br>GAATCCGGCGCAGGTAGCGAAACTGCAACCTCTGGTTCCGAGACTGCAGGT<br>ACTAGCGAATCTGCTACTAGCGAATCCGGCGCAGGTACTAGCGAATCCGCT<br>ACCAGCGAATCCGGCGCAGGTAGCGAAACTGCAACCTCTGGTTCCGAGACT<br>GCAGGTAGCGAAACCGCTACCTCTGGTTCCGAAACTGCAGGTACTTCTACCG<br>AGGCTAGCGAAGGTTCTGCATCAGGTAGCACTGCTGGTTCCGAGACTTCTAC<br>TGAAGCAGGTAGCGAAACTGCTACTTCCGGCTCTGAGACTGCAGGTACTAG<br>TGAATCCGCAACTAGCGAATCTGGCGCAGGTAGCACTGCAGGCTCTGAGAC<br>TTCCACTGAAGCAGGTAGCACTGCTGGTTCCGAAACCTCTACCGAAGCAGGT<br>AGCACTGCAGGTTCTGAAACCTCCACTGAAGCAGGTACTTCCACTGAGGCTA<br>GTGAAGGCTCTGCATCAGGTAGCACTGCTGGTTCCGAAACCTCTACCGAAGC<br>AGGTAGCACTGCAGGTTCTGAAACCTCCACTGAAGCAGGTACTTCCACTGA<br>GGCTAGTGAAGGCTCTGCATCAGGTAGCACTGCAGGTTCTGAGACTTCCACC<br>GAAGCAGGTAGCGAAACTGCTACTTCTGGTTCCGAAACTGCAGGTACTTCCA<br>CTGAAGCTAGTGAAGGTTCCGCATCAGGTACTAGTGAGTCCGCAACCAGCG<br>AATCCGGCGCAGGTAGCGAAACCGCAACCTCCGGTTCTGAAACTGCAGGTA<br>CTAGCGAATCCGCAACCAGCGAATCTGGCGCAGGTACTAGTGAGTCCGCAA<br>CCAGCGAATCCGGCGCAGGTAGCGAAACCGCAACCTCCGGTTCTGAAACTG<br>CAGGTACTAGCGAATCCGCAACCAGCGAATCTGGCGCAGGTAGCGAAACTG<br>CTACTTCCGGCTCTGAGACTGCAGGTACTTCCACCGAAGCAAGCGAAGGTTC<br>CGCATCAGGTACTTCCACCGAGGCTAGTGAAGGCTCTGCATCAGGTAGCACT<br>GCTGGCTCCGAGACTTCTACCGAAGCAGGTAGCACTGCAGGTTCCGAAACTT<br>CCACTGAAGCAGGTAGCGAAACTGCTACCTCTGGCTCTGAGACTGCAGGTA<br>CTAGCGAATCTGCTACTAGCGAATCCGGCGCAGGTACTAGCGAATCCGCTA<br>CCAGCGAATCCGGCGCAGGTAGCGAAACTGCAACCTCTGGTTCCGAGACTG<br>CAGGTAGCGAAACTGCTACTTCCGGCTCCGAGACTGCAGGTAGCGAAACTG<br>CTACTTCTGGCTCCGAAACTGCAGGTACTTCTACTGAGGCTAGTGAAGGTTC<br>CGCATCAGGTACTAGCGAGTCCGCAACCAGCGAATCCGGCGCAGGTAGCGA<br>AACTGCTACCTCTGGCTCCGAGACTGCAGGTAGCGAAACTGCAACCTCTGGC<br>TCTGAAACTGCAGGTACTAGCGAATCTGCTACTAGCGAATCCGGCGCAGGT |

TABLE 7-continued

DNA sequences of XTEN and precursor sequences

| XTEN Name | SEQ ID NO: | DNA Nucleotide Sequence |
|---|---|---|
| | | ACTAGCGAATCCGCTACCAGCGAATCCGGCGCAGGTAGCGAAACTGCAACC TCTGGTTCCGAGACTGCA |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferase, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization is performed using computer programs (Gustafsson, C., et al. (2004) *Trends Biotechnol,* 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in *E. coli*). In the case of *E. coli*, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene comprises one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 124). In another embodiment, a sequencing island is the sequence 5'-AGGTCCAGAACCAACGGGGCCGGC-CCCAAGCGGAGGT-3' (SEQ ID NO: 125).

In one embodiment, polynucleotide libraries are constructed using the disclosed methods wherein all members of the library encode the same amino acid sequence but where codon usage for the respective amino acids in the sequence is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences allows some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Figure 2:
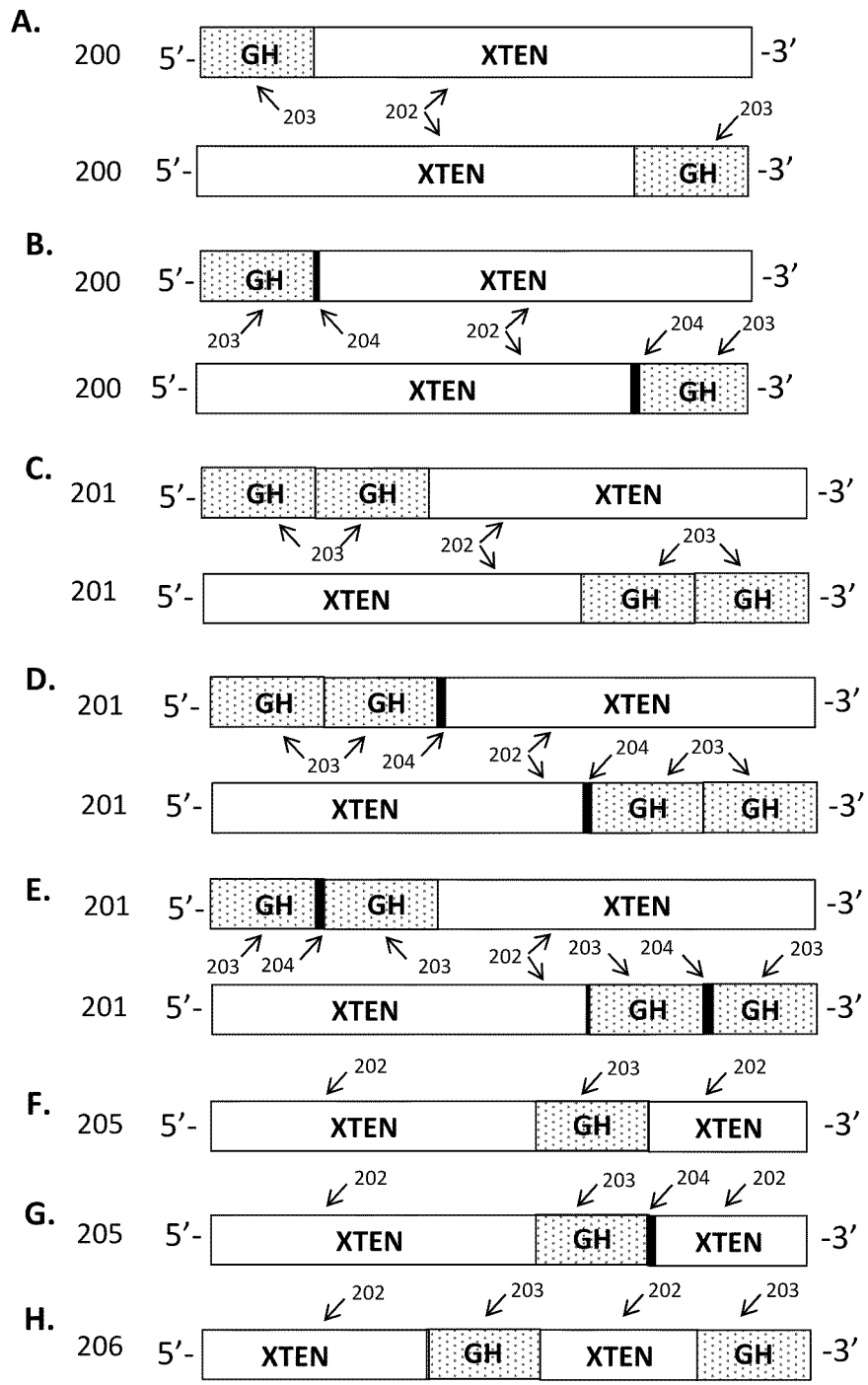
FIGS. 2A-H show schematic illustrations of exemplary polynucleotide constructs of GHXTEN genes that encode the corresponding GHXTEN polypeptides of FIG. 1; all depicted in a 5' to 3' orientation. In these illustrative examples the genes encode GHXTEN fusion proteins with one GH and XTEN (200); or one GH, one spacer sequence and one XTEN (200); two GH and one XTEN (201); or two GH, a spacer sequence and one XTEN (201); one GH and two XTEN (205); or two GH and two XTEN (206). In these depictions, the polynucleotides encode the following components: XTEN (202), GH (203), and spacer amino acids that can include a cleavage sequence (204), with all sequences linked in frame.

Once the gene that encodes the XTEN of desired length and properties is selected, it is genetically fused to the nucleotides encoding the N- and/or the C-terminus of the GH gene(s) by cloning it into the construct adjacent and in frame with the gene coding for GH or, optionally, adjacent to a spacer sequence. The invention provides various permutations of the foregoing, depending on the GHXTEN to be encoded. For example, a gene encoding a GHXTEN fusion protein comprising a GH and two XTEN, such as embodied by formula VI, as depicted above, the gene would have polynucleotides encoding GH, encoding two XTEN sequences, which can be identical or different in composition and sequence length. In one non-limiting embodiment of the foregoing, the GH polynucleotides would encode bovine growth hormone and the polynucleotides encoding the N-terminus XTEN would encode AE912 and the polynucleotides encoding the C-terminus XTEN would encode AE144. The step of cloning the GH genes into the XTEN construct can occur through a ligation or multimerization step. As shown in FIG. 2, the constructs encoding GHXTEN fusion proteins can be designed in different configurations of the components XTEN 202, GH 203, and spacer sequences 204. In one embodiment, as illustrated in FIG. 2A, the construct comprises polynucleotide sequences complementary to, or those that encode a monomeric polypeptide of components in the following order (5' to 3') GH 203 and XTEN 202, or the reverse order. In another embodiment, as illustrated in FIG. 2B, the construct comprises polynucleotide sequences complementary to, or those that encode a monomeric polypeptide of components in the following order (5' to 3') GH 203, spacer sequence 204, and XTEN 202, or the reverse order. In another embodiment, as illustrated in FIG. 2C, the construct 201 encodes a monomeric GHXTEN comprising polynucleotide sequences complementary to, or those that encode components in the following order (5' to 3'): two molecules of GH 203 and XTEN 202, or the reverse order. In another embodiment, as illustrated in FIG. 2D, the construct comprises polynucleotide sequences complementary to, or those that encode a monomeric polypeptide of components in the following order (5' to 3'): two molecules of GH 203, spacer sequence 204, and XTEN 202, or the reverse order. In another embodiment, as illustrated in FIG. 2E, the construct comprises polynucleotide sequences complementary to, or those that encode a monomeric polypeptide of components in the following order (5' to 3'): GH 203, spacer sequence 204, a second molecule of GH 203, and XTEN 202, or the reverse order. In another embodiment, as illustrated in FIG. 2F, the construct comprises polynucleotide sequences complementary to, or those that encode a monomeric polypeptide of components in the following order (5' to 3'): GH 203, XTEN 202, GH 203, and a second XTEN 202, or the reverse sequence. The spacer polynucleotides can optionally comprise sequences encoding cleavage sequences. As will be apparent to those of skill in the art, other permutations of the foregoing are possible.

The invention also encompasses polynucleotides comprising XTEN-encoding polynucleotide variants that have a high percentage of sequence identity to (a) a polynucleotide sequence from Table 7, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the GHXTEN sequences under stringent conditions, such as those described herein.

The resulting polynucleotides encoding the GHXTEN chimeric fusion proteins can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage. The invention provides for the use of plasmid vectors containing replication and control sequences that are compatible with and recognized by the host cell, and are operably linked to the GHXTEN gene for controlled expression of the GHXTEN fusion proteins. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. Such control sequences include a promoter to effect transcription, an optional operator sequence to control such transcription, a sequence encoding suitable mRNA ribosome binding sites, and sequences that control termination of transcription and translation. Other suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all would be operably linked to the DNA encoding GHXTEN polypeptides. Promoters for use in bacterial systems can also contain a Shine-Dalgarno (S.D.) sequence, operably linked to the DNA encoding GHXTEN polypeptides.

The invention contemplates use of other expression systems including, for example, a baculovirus expression system with both non-fusion transfer vectors, such as, but not limited to pVL941 Summers, et al., Virology 84:390-402 (1978)), pVL1393 (Invitrogen), pVL1392 (Summers, et al., Virology 84:390-402 (1978) and Invitrogen) and pBlueBacIII (Invitrogen), and fusion transfer vectors such as, but not limited to, pAc7 00 (Summers, et al., Virology 84:390-402 (1978)), pAc701 and pAc70-2 (same as pAc700, with different reading frames), pAc360 Invitrogen) and pBlueBacHisA, B, C (Invitrogen) can be used.

Mammalian expression vectors can comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (Randal J. Kaufman, 1991, Randal J. Kaufman, Current Protocols in Molecular Biology, 16, 12 (1991)). Alternatively a glutamine synthetase/methionine sulfoximine co-amplification vector, such as pEE14 (Celltech). A vector that directs episomal expression under the control of the Epstein Barr Virus (EBV) or nuclear antigen (EBNA) can be used such as pREP4 (Invitrogen), pCEP4 (Invitrogen), pMEP4 (Invitrogen), pREP8 (Invitrogen), pREP9 (Invitrogen), and pEBVHis (Invitrogen).

Selectable mammalian expression vectors for use in the invention include, but are not limited to, pRc/CMV (Invitrogen), pRc/RSV (Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11, pMJ601 pTKgptF1S and the like.

Yeast expression systems that can also be used in the present invention include, but are not limited to, the nonfusion pYES2 vector (Invitrogen), the fusion pYESHisA, B, C (Invitrogen), pRS vectors and the like.

In addition, the expression vector containing the chimeric GHXTEN fusion protein-encoding polynucleotide molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR) inhibitor, guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

In one embodiment, the polynucleotide encoding a GHXTEN fusion protein composition is fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for $E.\ coli$ expression. Signal peptides preferred for yeast expression are ppL-alpha, DEX4, invertase signal peptide, acid phosphatase signal peptide, CPY, or INU1. For insect cell expression the preferred signal sequences are sexta adipokinetic hormone precursor, CP1, CP2, CP3, CP4, TPA, PAP, or gp67. For mammalian expression the preferred signal sequences are IL2L, SV40, IgG kappa and IgG lambda.

In another embodiment, a leader sequence, potentially comprising a well-expressed, independent protein domain, can be fused to the N-terminus of the GHXTEN sequence, separated by a protease cleavage site. While any leader peptide sequence which does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 126), FLAG tag, hemaglutinin tag, and green fluorescent protein. The leader sequence can also be further improved by codon optimization, especially in the second codon position following the ATG start codon, by methods well described in the literature and hereinabove.

Various in vitro enzymatic methods for cleaving proteins at specific sites are known. Such methods include use of enterokinase (DDDK (SEQ ID NO: 127)), Factor Xa (IDGR (SEQ ID NO: 128)), thrombin (LVPRGS (SEQ ID NO: 129)), PreScission™ (LEVLFQGP (SEQ ID NO: 130)), TEV protease (EQLYFQG (SEQ ID NO: 131)), 3C protease (ETLFQGP (SEQ ID NO: 132)), Sortase A (LPETG (SEQ ID NO: 133)), Granzyme B (D/X, N/X, M/N or S/X), inteins, SUMO, DAPase (TAGZyme™), Aeromonas aminopeptidase, Aminopeptidase M, and carboxypeptidases A and B. Additional methods are disclosed in Arnau, et al., Protein Expression and Purification 48: 1-13 (2006).

In other cases, the invention provides constructs and methods of making constructs comprising an polynucleotide sequence optimized for expression that encodes at least about 20 to about 60 amino acids with XTEN characteristics that can be included at the N-terminus of an XTEN carrier encoding sequence (in other words, the polynucleotides encoding the 20-60 encoded optimized amino acids are linked in frame to polynucleotides encoding an XTEN component that is N-terminal to GH) to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity to AE912. In another embodiment of the foregoing, the optimized polynucleotide encodes an XTEN sequence with at least about 90% sequence identity to AM923. In another embodiment of the foregoing, the optimized polynucleotide encodes an XTEN sequence with at least about 90% sequence identity to AE48. In another embodiment of the foregoing, the optimized polynucleotide encodes an XTEN sequence with at least about 90% sequence identity to AM48. In one embodiment, the optimized polynucleotide NTS comprises a sequence that exhibits at least about 80%, at least about 85%, at least about 90%, at least about 91%, at least about 92%, at least about 93%, at least about 94%, at least about 95%, at least about 96%, at least about 97%, at least about 98%, or at least about 99%, sequence identity to a sequence or its complement selected from

AE 48:
(SEQ ID NO: 134)
5'-ATGGCTGAACCTGCTGGCTCTCCAACCTCCACTGAGGAAGGTACCC

CGGGTAGCGGTACTGCTTCTTCCTCTCCAGGTAGCTCTACCCCTTCTGG

TGCAACCGGCTCTCCAGGTGCTTCTCCGGGCACCAGCTCTACCGGTTC

TCCA-3'
and

AM 48:
(SEQ ID NO: 135)
5'-ATGGCTGAACCTGCTGGCTCTCCAACCTCCACTGAGGAAGGTGCAT

CCCCGGGCACCAGCTCTACCGGTTCTCCAGGTAGCTCTACCCCGTCTGG

TGCTACCGGCTCTCCAGGTAGCTCTACCCCGTCTGGTGCTACTGGCTCTC

CA-3'

In another embodiment, the protease site of the leader sequence construct is chosen such that it is recognized by an in vivo protease. In this embodiment, the protein is purified from the expression system while retaining the leader by avoiding contact with an appropriate protease. The full-length construct is then injected into a patient. Upon injection, the construct comes into contact with the protease specific for the cleavage site and is cleaved by the protease. In the case where the uncleaved protein is substantially less active than the cleaved form, this method has the beneficial effect of allowing higher initial doses while avoiding toxicity, as the active form is generated slowly in vivo. Some non-limiting examples of in vivo proteases which are useful for this application include tissue kallikrein, plasma kallikrein, trypsin, pepsin, chymotrypsin, thrombin, and matrix metalloproteinases, or the proteases of Table 6.

In this manner, a chimeric DNA molecule coding for a monomeric GHXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for expression of the chimeric DNA molecule encoding of GHXTEN.

The present invention also provides a host cell for expressing the monomeric fusion protein compositions disclosed herein. Examples of suitable eukaryotic host cells include, but are not limited to mammalian cells, such as VERO cells, HELA cells such as ATCC No. CCL2, CHO cell lines, COS cells, WI38 cells, BHK cells, HepG2 cells, 3T3 cells, A549 cells, PC12 cells, K562 cells, 293 cells, Sf9 cells and CvI cells. Examples of suitable non-mammalian eukaryotic cells include eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 [1988]); *Candida; Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., Biochem. Biophys. Res. Commun., 112:284-289 [1983]; Tilburn et al., Gene, 26:205-221 [1983]; Yelton et al., Proc. Natl. Acad. Sci. USA, 81: 1470-1474 [1984]) and *A. niger* (Kelly and Hynes, EMBO J., 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis,* and *Rhodotorula*. A list of specific species that are exemplary of this class of yeasts may be found in C. Anthony, The Biochemistry of Methylotrophs, 269 (1982).

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma;* and *Vibrio*. Non-limiting examples of specific strains include: *Archaeoglobus fulgidus; Bdellovibrio bacteriovorus; Borrelia burgdorferi; Chloroflexus aurantiacus; Enterococcus faecalis; Enterococcus faecium; Lactobacillus johnsonii; Lactobacillus plantarum; Lactococcus lactis; Listeria innocua; Listeria monocytogenes; Oceanobacillus iheyensis; Paracoccus zeaxanthinifaciens; Pseudomonas mevalonii; Staphylococcus aureus; Staphylococcus epidermidis; Staphylococcus haemolyticus; Streptococcus agalactiae; Streptomyces griseolosporeus; Streptococcus mutans; Streptococcus pneumoniae; Streptococcus pyogenes; Thermoplasma acidophilum; Thermoplasma volcanium; Vibrio cholerae; Vibrio parahaemolyticus;* and *Vibrio vulnificus*.

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. For compositions secreted by the host cells, supernatant from centrifugation is separated and retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include, but are not limited to leupeptin, pepstatin or aprotinin. The supernatant then may be precipitated in successively increasing concentrations of saturated ammonium sulfate.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence GH polypeptide or against a synthetic peptide based on the DNA sequences provided herein or against exogenous sequence fused to GH and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed GHXTEN polypeptide product(s) may be purified via methods known in the art or by methods disclosed herein. Procedures such as gel filtration, affinity purification, salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Some expressed GHXTEN may require refolding during isolation and purification. Methods of purification are described in Robert K. Scopes, Protein Purification Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

VIII). Pharmaceutical Compositions

The present invention provides pharmaceutical compositions comprising GHXTEN. In one embodiment, the pharmaceutical composition comprises the GHXTEN fusion protein and at least one pharmaceutically acceptable carrier. GHXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions.

The pharmaceutical compositions can be administered orally, intranasally, parenterally or by inhalation therapy, and may take the form of tablets, lozenges, granules, capsules, pills, ampoules, suppositories or aerosol form. They may also take the form of suspensions, solutions and emulsions of the active ingredient in aqueous or nonaqueous diluents, syrups, granulates or powders. In addition, the pharmaceutical compositions can also contain other pharmaceutically active compounds or a plurality of compounds of the invention.

More particularly, the present pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In one embodiment, the pharmaceutical composition is administered subcutaneously. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., carnauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tabletting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof. Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (non-polar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126,966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phosphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[1-(2,3,-dioleyloxy)propyl]-N,N-dimethyl-N-hydroxy ethylammonium bromide (DORIE); N-[1-(2,3-dioleyloxy)propyl]-N,N,N-trimethylammonium chloride (DOTMA); 3 [N—(N',N'-dimethylaminoethane) carbamoly] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294,191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660, 848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

IX). Pharmaceutical Kits

In another aspect, the invention provides a kit to facilitate the use of the GHXTEN polypeptides. The kit comprises the pharmaceutical composition provided herein, a label identifying the pharmaceutical composition, and an instruction for storage, reconstitution and/or administration of the pharmaceutical compositions to an animal In some embodiment, the kit comprises, preferably: (a) an amount of a GHXTEN fusion protein composition sufficient to treat an animal; and (b) an amount of a pharmaceutically acceptable carrier; together in a formulation ready for injection or for reconstitution with sterile water, buffer, or dextrose; together with a label identifying the GHXTEN drug and storage and handling conditions, and a sheet of the approved indications for the drug, instructions for the reconstitution and/or administration of the GHXTEN drug for the use for the prevention and/or treatment of an approved indication, appropriate dosage and safety information, and information identifying the lot and expiration of the drug. In another embodiment of the foregoing, the kit can comprise a second container that can carry a suitable diluent for the GHXTEN composition, which will provide the user with the appropriate concentration of GHXTEN to be delivered to the animal.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence [X]$_3$ where X is a 12 mer peptide with the sequences: GESPGGSSGSES (SEQ ID NO: 136), GSEGSSGPGESS (SEQ ID NO: 137), GSSESGSSEGGP (SEQ ID NO: 138), or GSGGEPSESGSS (SEQ ID NO: 139). The insert was obtained by annealing the following pairs of phosphorylated synthetic oligonucleotide pairs:

```
AD1for:
                                     (SEQ ID NO: 140)
AGGTGAATCTCCDGGTGGYTCYAGCGGTTCYGARTC AD1rev:
                                     (SEQ ID NO: 141)
ACCTGAYTCRGAACCGCTRGARCCACCHGGAGATTC AD2for:
                                     (SEQ ID NO: 142)
AGGTAGCGAAGGTTCTTCYGGTCCDGGYGARTCYTC AD2rev:
                                     (SEQ ID NO: 143)
ACCTGARGAYTCRCCHGGACCRGAAGAACCTTCGCT AD3for:
                                     (SEQ ID NO: 144)
AGGTTCYTCYGAAAGCGGTTCTTCYGARGGYGGTCC AD3rev:
                                     (SEQ ID NO: 145)
ACCTGGACCRCCYTCRGAAGAACCGCTTTCRGARGA AD4for:
                                     (SEQ ID NO: 146)
AGGTTCYGGTGGYGAACCDTCYGARTCTGGTAGCTC
```

We also annealed the phosphorylated oligonucleotide 3 KpnIstopperFor: AGGTTCGTCTTCACTCGAGGGTAC (SEQ ID NO: 147) and the non-phosphorylated oligonucleotide pr_3 KpnIstopperRev: CCTCGAGTGAAGACGA (SEQ ID NO: 148). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs for these segments are listed in Table 8.

TABLE 8

| DNA and Amino Acid Sequences for 36-mer motifs | | | | |
|---|---|---|---|---|
| File name | Amino acid sequence | SEQ ID NO: | Nucleotide sequence | SEQ ID NO: |
| LCW0401_001_GFP-N_A01.ab1 | GSGGEPSESGSSGESPGG SSGSESGESPGGSSGSES | 149 | GGTTCTGGTGGCGAACCGTCCGAG TCTGGTAGCTCAGGTGAATCTCCG GGTGGCTCTAGCGGTTCCGAGTCA | 150 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| | | | GGTGAATCTCCTGGTGGTTCCAGC GGTTCCGAGTCA | |
| LCW0401_002_GFP-N_B01.ab1 | GSEGSSGPGESSGESPGG SSGSESGSSESGSSEGGP | 151 | GGTAGCGAAGGTTCTTCTGGTCCTG GCGAGTCTTCAGGTGAATCTCCTG GTGGTTCCAGCGGTTCTGAATCAG GTTCCTCCGAAAGCGGTTCTTCCGA GGGCGGTCCA | 152 |
| LCW0401_003_GFP-N_C01.ab1 | GSSESGSSEGGPGSSESG SSEGGPGESPGGSSGSES | 153 | GGTTCCTCTGAAAGCGGTTCTTCCG AAGGTGGTCCAGGTTCCTCTGAAA GCGGTTCTTCTGAGGGTGGTCCAG GTGAATCTCCGGGTGGCTCCAGCG GTTCCGAGTCA | 154 |
| LCW0401_004_GFP-N_D01.ab1 | GSGGEPSESGSSGSSESG SSEGGPGSGGEPSESGSS | 155 | GGTTCCGGTGGCGAACCGTCTGAA TCTGGTAGCTCAGGTTCTTCTGAAA GCGGTTCTTCCGAGGGTGGTCCAG GTTCTGGTGGTGAACCTTCCGAGTC TGGTAGCTCA | 156 |
| LCW0401_007_GFP-N_F01.ab1 | GSSESGSSEGGPGSEGSS GPGESSGSEGSSGPGESS | 157 | GGTTCTTCCGAAAGCGGTTCTTCTG AGGGTGGTCCAGGTAGCGAAGGTT CTTCCGGTCCAGGTGAGTCTTCAGG TAGCGAAGGTTCTTCTGGTCCTGGT GAATCTTCA | 158 |
| LCW0401_008_GFP-N_G01.ab1 | GSSESGSSEGGPGESPGG SSGSESGSEGSSGPGESS | 159 | GGTTCCTCTGAAAGCGGTTCTTCCG AGGGTGGTCCAGGTGAATCTCCAG GTGGTTCCAGCGGTTCTGAGTCAG GTAGCGAAGGTTCTTCTGGTCCAG GTGAATCCTCA | 160 |
| LCW0401_012_GFP-N_H01.ab1 | GSGGEPSESGSSGSGGEP SESGSSGSEGSSGPGESS | 161 | GGTTCTGGTGGTGAACCGTCTGAG TCTGGTAGCTCAGGTTCCGGTGGC GAACCATCCGAATCTGGTAGCTCA GGTAGCGAAGGTTCTTCCGGTCCA GGTGAGTCTTCA | 162 |
| LCW0401_015_GFP-N_A02.ab1 | GSSESGSSEGGPGSEGSS GPGESSGESPGGSSGSES | 163 | GGTTCTTCCGAAAGCGGTTCTTCCG AAGGCGGTCCAGGTAGCGAAGGTT CTTCTGGTCCAGGCGAATCTTCAGG TGAATCTCCTGGTGGCTCCAGCGGT TCTGAGTCA | 164 |
| LCW0401_016_GFP-N_B02.ab1 | GSSESGSSEGGPGSSESG SSEGGPGSSESGSSEGGP | 165 | GGTTCCTCCGAAAGCGGTTCTTCTG AGGGCGGTCCAGGTTCCTCCGAAA GCGGTTCTTCCGAGGGCGGTCCAG GTTCTTCTGAAAGCGGTTCTTCCGA GGGCGGTCCA | 166 |
| LCW0401_020_GFP-N_E02.ab1 | GSGGEPSESGSSGSEGSS GPGESSGSSESGSSEGGP | 167 | GGTTCCGGTGGCGAACCGTCCGAA TCTGGTAGCTCAGGTAGCGAAGGT TCTTCTGGTCCAGGCGAATCTTCAG GTTCCTCTGAAAGCGGTTCTTCTGA GGGCGGTCCA | 168 |
| LCW0401_022_GFP-N_F02.ab1 | GSGGEPSESGSSGSSESG SSEGGPGSGGEPSESGSS | 169 | GGTTCTGGTGGTGAACCGTCCGAA TCTGGTAGCTCAGGTTCTTCCGAAA GCGGTTCTTCTGAAGGTGGTCCAG GTTCCGGTGGCGAACCTTCTGAATC TGGTAGCTCA | 170 |
| LCW0401_024_GFP-N_G02.ab1 | GSGGEPSESGSSGSSESG SSEGGPGESPGGSSGSES | 171 | GGTTCTGGTGGCGAACCGTCCGAA TCTGGTAGCTCAGGTTCCTCCGAAA GCGGTTCTTCTGAAGGTGGTCCAG GTGAATCTCCAGGTGGTTCTAGCG GTTCTGAATCA | 172 |
| LCW0401_026_GFP-N_H02.ab1 | GSGGEPSESGSSGESPGG SSGSESGSEGSSGPGESS | 173 | GGTTCTGGTGGCGAACCGTCTGAG TCTGGTAGCTCAGGTGAATCTCCTG GTGGCTCCAGCGGTTCTGAATCAG GTAGCGAAGGTTCTTCTGGTCCTGG TGAATCTTCA | 174 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_027_GFP-N_A03.ab1 | GSGGEPSESGSSGESPGG SSGSESGSGGEPSESGSS | 175 | GGTTCCGGTGGCGAACCTTCCGAA TCTGGTAGCTCAGGTGAATCTCCG GGTGGTTCTAGCGGTTCTGAGTCA GGTTCTGGTGGTGAACCTTCCGAGT CTGGTAGCTCA | 176 |
| LCW0401_028_GFP-N_B03.ab1 | GSSESGSSEGGPGSSESG SSEGGPGSSESGSSEGGP | 177 | GGTTCCTCTGAAAGCGGTTCTTCTG AGGGCGGTCCAGGTTCTTCCGAAA GCGGTTCTTCCGAGGGCGGTCCAG GTTCTTCCGAAAGCGGTTCTTCTGA AGGCGGTCCA | 178 |
| LCW0401_030_GFP-N_C03.ab1 | GESPGGSSGSESGSEGSS GPGESSGSEGSSGPGESS | 179 | GGTGAATCTCCGGGTGGCTCCAGC GGTTCTGAGTCAGGTAGCGAAGGT TCTTCCGGTCCGGGTGAGTCCTCAG GTAGCGAAGGTTCTTCCGGTCCTG GTGAGTCTTCA | 180 |
| LCW0401_031_GFP-N_D03.ab1 | GSGGEPSESGSSGSGGEP SESGSSGSSESGSSEGGP | 181 | GGTTCTGGTGGCGAACCTTCCGAA TCTGGTAGCTCAGGTTCCGGTGGTG AACCTTCTGAATCTGGTAGCTCAG GTTCTTCTGAAAGCGGTTCTTCCGA GGGCGGTCCA | 182 |
| LCW0401_033_GFP-N_E03.ab1 | GSGGEPSESGSSGSGGEP SESGSSGSGGEPSESGSS | 183 | GGTTCCGGTGGTGAACCTTCTGAAT CTGGTAGCTCAGGTTCCGGTGGCG AACCATCCGAGTCTGGTAGCTCAG GTTCCGGTGGTGAACCATCCGAGT CTGGTAGCTCA | 184 |
| LCW0401_037_GFP-N_F03.ab1 | GSGGEPSESGSSGSSESG SSEGGPGSEGSSGPGESS | 185 | GGTTCCGGTGGCGAACCTTCTGAA TCTGGTAGCTCAGGTTCCTCCGAAA GCGGTTCTTCTGAGGGCGGTCCAG GTAGCGAAGGTTCTTCTGGTCCGG GCGAGTCTTCA | 186 |
| LCW0401_038_GFP-N_G03.ab1 | GSGGEPSESGSSGSEGSS GPGESSGSGGEPSESGSS | 187 | GGTTCCGGTGGTGAACCGTCCGAG TCTGGTAGCTCAGGTAGCGAAGGT TCTTCTGGTCCGGGTGAGTCTTCAG GTTCTGGTGGCGAACCGTCCGAAT CTGGTAGCTCA | 188 |
| LCW0401_039_GFP-N_H03.ab1 | GSGGEPSESGSSGESPGG SSGSESGSGGEPSESGSS | 189 | GGTTCTGGTGGCGAACCGTCCGAA TCTGGTAGCTCAGGTGAATCTCCTG GTGGTTCCAGCGGTTCCGAGTCAG GTTCTGGTGGCGAACCTTCCGAATC TGGTAGCTCA | 190 |
| LCW0401_040_GFP-N_A04.ab1 | GSSESGSSEGGPGSGGEP SESGSSGSSESGSSEGGP | 191 | GGTTCTTCCGAAAGCGGTTCTTCCG AGGGCGGTCCAGGTTCCGGTGGTG AACCATCTGAATCTGGTAGCTCAG GTTCTTCTGAAAGCGGTTCTTCTGA AGGTGGTCCA | 192 |
| LCW0401_042_GFP-N_C04.ab1 | GSEGSSGPGESSGESPGG SSGSESGSEGSSGPGESS | 193 | GGTAGCGAAGGTTCTTCCGGTCCT GGTGAGTCTTCAGGTGAATCTCCA GGTGGCTCTAGCGGTTCCGAGTCA GGTAGCGAAGGTTCTTCTGGTCCTG GCGAGTCCTCA | 194 |
| LCW0401_046_GFP-N_D04.ab1 | GSSESGSSEGGPGSSESG SSEGGPGSSESGSSEGGP | 195 | GGTTCCTCTGAAAGCGGTTCTTCCG AAGGCGGTCCAGGTTCTTCCGAAA GCGGTTCTTCTGAGGGCGGTCCAG GTTCCTCCGAAAGCGGTTCTTCTGA GGGTGGTCCA | 196 |
| LCW0401_047_GFP-N_E04.ab1 | GSGGEPSESGSSGESPGG SSGSESGESPGGSSGSES | 197 | GGTTCTGGTGGCGAACCTTCCGAG TCTGGTAGCTCAGGTGAATCTCCG GGTGGTTCTAGCGGTTCCGAGTCA GGTGAATCTCCGGGTGGTTCCAGC GGTTCTGAGTCA | 198 |
| LCW0401_051_GFP-N_F04.ab1 | GSGGEPSESGSSGSEGSS GPGESSGESPGGSSGSES | 199 | GGTTCTGGTGGCGAACCATCTGAG TCTGGTAGCTCAGGTAGCGAAGGT TCTTCCGGTCCAGGCGAGTCTTCAG | 200 |

TABLE 8-continued

DNA and Amino Acid Sequences for 36-mer motifs

| File name | Amino acid sequence | SEQ ID NO: | Nucleotide sequence | SEQ ID NO: |
|---|---|---|---|---|
| | | | GTGAATCTCCTGGTGGCTCCAGCG GTTCTGAGTCA | |
| LCW0401_053_GFP-N_H04.ab1 | GESPGGSSGSESGESPGG SSGSESGESPGGSSGSES | 201 | GGTGAATCTCCTGGTGGTTCCAGC GGTTCCGAGTCAGGTGAATCTCCA GGTGGCTCTAGCGGTTCCGAGTCA GGTGAATCTCCTGGTGGTTCTAGCG GTTCTGAATCA | 202 |
| LCW0401_054_GFP-N_A05.ab1 | GSEGSSGPGESSGSEGSS GPGESSGSGGEPSESGSS | 203 | GGTAGCGAAGGTTCTTCCGGTCCA GGTGAATCTTCAGGTAGCGAAGGT TCTTCTGGTCCTGGTGAATCCTCAG GTTCCGGTGGCGAACCATCTGAAT CTGGTAGCTCA | 204 |
| LCW0401_059_GFP-N_D05.ab1 | GSGGEPSESGSSGSEGSS GPGESSGESPGGSSGSES | 205 | GGTTCTGGTGGCGAACCATCCGAA TCTGGTAGCTCAGGTAGCGAAGGT TCTTCTGGTCCTGGCGAATCTTCAG GTGAATCTCCAGGTGGCTCTAGCG GTTCCGAATCA | 206 |
| LCW0401_060_GFP-N_E05.ab1 | GSGGEPSESGSSGSSESG SSEGGPGSGGEPSESGSS | 207 | GGTTCCGGTGGTGAACCGTCCGAA TCTGGTAGCTCAGGTTCCTCTGAAA GCGGTTCTTCCGAGGGTGGTCCAG GTTCCGGTGGTGAACCTTCTGAGTC TGGTAGCTCA | 208 |
| LCW0401_061_GFP-N_F05.ab1 | GSSESGSSEGGPGSGGEP SESGSSGSEGSSGPGESS | 209 | GGTTCCTCTGAAAGCGGTTCTTCTG AGGGCGGTCCAGGTTCTGGTGGCG AACCATCTGAATCTGGTAGCTCAG GTAGCGAAGGTTCTTCCGGTCCGG GTGAATCTTCA | 210 |
| LCW0401_063_GFP-N_H05.ab1 | GSGGEPSESGSSGSEGSS GPGESSGSEGSSGPGESS | 211 | GGTTCTGGTGGTGAACCGTCCGAA TCTGGTAGCTCAGGTAGCGAAGGT TCTTCTGGTCCTGGCGAGTCTTCAG GTAGCGAAGGTTCTTCTGGTCCTGG TGAATCTTCA | 212 |
| LCW0401_066_GFP-N_B06.ab1 | GSGGEPSESGSSGSSESG SSEGGPGSGGEPSESGSS | 213 | GGTTCTGGTGGCGAACCATCCGAG TCTGGTAGCTCAGGTTCTTCCGAAA GCGGTTCTTCCGAAGGCGGTCCAG GTTCTGGTGGTGAACCGTCCGAAT CTGGTAGCTCA | 214 |
| LCW0401_067_GFP-N_C06.ab1 | GSGGEPSESGSSGESPGG SSGSESGESPGGSSGSES | 215 | GGTTCCGGTGGCGAACCTTCCGAA TCTGGTAGCTCAGGTGAATCTCCG GGTGGTTCTAGCGGTTCCGAATCA GGTGAATCTCCAGGTGGTTCTAGC GGTTCCGAATCA | 216 |
| LCW0401_069_GFP-N_D06.ab1 | GSGGEPSESGSSGSGGEP SESGSSGESPGGSSGSES | 217 | GGTTCCGGTGGTGAACCATCTGAG TCTGGTAGCTCAGGTTCCGGTGGC GAACCGTCCGAGTCTGGTAGCTCA GGTGAATCTCCGGGTGGTTCCAGC GGTTCCGAATCA | 218 |
| LCW0401_070_GFP-N_E06.ab1 | GSEGSSGPGESSGSSESG SSEGGPGSEGSSGPGESS | 219 | GGTAGCGAAGGTTCTTCTGGTCCG GGCGAATCCTCAGGTTCCTCCGAA AGCGGTTCTTCCGAAGGTGGTCCA GGTAGCGAAGGTTCTTCCGGTCCT GGTGAATCTTCA | 220 |
| LCW0401_078_GFP-N_F06.ab1 | GSSESGSSEGGPGESPGG SSGSESGESPGGSSGSES | 221 | GGTTCCTCTGAAAGCGGTTCTTCTG AAGGCGGTCCAGGTGAATCTCCGG GTGGCTCCAGCGGTTCTGAATCAG GTGAATCTCCTGGTGGCTCCAGCG GTTCCGAGTCA | 222 |
| LCW0401_079_GFP-N_G06.ab1 | GSEGSSGPGESSGSEGSS GPGESSGSGGEPSESGSS | 223 | GGTAGCGAAGGTTCTTCTGGTCCA GGCGAGTCTTCAGGTAGCGAAGGT TCTTCCGGTCCTGGCGAGTCTTCAG GTTCCGGTGGCGAACCGTCCGAAT CTGGTAGCTCA | 224 |

Example 2

Construction of XTEN_AE36 Segments

A codon library encoding XTEN sequences of 36 amino acid length was constructed. The XTEN sequence was designated XTEN_AE36. Its segments have the amino acid sequence [X]₃ where X is a 12 mer peptide with the sequence: GSPAGSPTSTEE (SEQ ID NO: 225), GSEPATSGSE TP (SEQ ID NO: 226), GTSESA TPESGP (SEQ ID NO: 227), or GTSTEPSEGSAP (SEQ ID NO: 228). The insert was obtained by annealing the following pairs of phosphorylated synthetic oligonucleotide pairs:

```
AE1for:
                                        (SEQ ID NO: 229)
AGGTAGCCCDGCWGGYTCTCCDACYTCYACYGARGA AE1rev:
                                        (SEQ ID NO: 230)
ACCTTCYTCRGTRGARGTHGGAGARCCWGCHGGGCT AE2for:
                                        (SEQ ID NO: 231)
AGGTAGCGAACCKGCWACYTCYGGYTCTGARACYCC AE2rev:
                                        (SEQ ID NO: 232)
ACCTGGRGTYTCAGARCCRGARGTWGCMGGTTCGCT AE3for:
                                        (SEQ ID NO: 233)
AGGTACYTCTGAAAGCGCWACYCCKGARTCYGGYCC AE3rev:
                                        (SEQ ID NO: 234)
ACCTGGRCCRGAYTCMGGRGTWGCGCTTTCAGARGT AE4for:
                                        (SEQ ID NO: 235)
AGGTACYTCTACYGAACCKTCYGARGGYAGCGCWCC AE4rev:
                                        (SEQ ID NO: 236)
ACCTGGWGCGCTRCCYTCRGAMGGTTCRGTAGARGT
```

We also annealed the phosphorylated oligonucleotide 3 KpnIstopperFor: AGGTTCGTCTTCACTCGAGGGTAC (SEQ ID NO: 237) and the non-phosphorylated oligonucleotide pr_3 KpnIstopperRev: CCTCGAGTGAAGACGA (SEQ ID NO: 238). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs for these segments are listed in Table 9.

TABLE 9

DNA and Amino Acid Sequences for 36-mer motifs

| File name | Amino acid sequence | SEQ ID NO: | Nucleotide sequence | SEQ ID NO: |
| --- | --- | --- | --- | --- |
| LCW0402_002_GFP-N_A07.ab1 | GSPAGSPTSTEEGTS ESATPESGPGTSTEP SEGSAP | 239 | GGTAGCCCGGCAGGCTCTCCGACCT CTACTGAGGAAGGTACTTCTGAAAG CGCAACCCCGGAGTCCGGCCCAGGT ACCTCTACCGAACCGTCTGAGGGCA GCGCACCA | 240 |
| LCW0402_003_GFP-N_B07.ab1 | GTSTEPSEGSAPGTS TEPSEGSAPGTSTEP SEGSAP | 241 | GGTACTTCTACCGAACCGTCCGAAG GCAGCGCTCCAGGTACCTCTACTGA ACCTTCCGAGGGCAGCGCTCCAGGT ACCTCTACCGAACCTTCTGAAGGTA GCGCACCA | 242 |
| LCW0402_004_GFP-N_C07.ab1 | GTSTEPSEGSAPGTS ESATPESGPGTSESA TPESGP | 243 | GGTACCTCTACCGAACCGTCTGAAG GTAGCGCACCAGGTACCTCTGAAAG CGCAACTCCTGAGTCCGGTCCAGGT ACTTCTGAAAGCGCAACCCCGGAGT CTGGCCCA | 244 |
| LCW0402_005_GFP-N_D07.ab1 | GTSTEPSEGSAPGTS ESATPESGPGTSESA TPESGP | 245 | GGTACTTCTACTGAACCGTCTGAAG GTAGCGCACCAGGTACTTCTGAAAG CGCAACCCCGGAATCCGGCCCAGGT ACCTCTGAAAGCGCAACCCCGGAGT CCGGCCCA | 246 |
| LCW0402_006_GFP-N_E07.ab1 | GSEPATSGSETPGTS ESATPESGPGSPAGS PTSTEE | 247 | GGTAGCGAACCGGCAACCTCCGGCT CTGAAACCCCAGGTACCTCTGAAAG CGCTACTCCTGAATCCGGCCCAGGT AGCCCGGCAGGTTCTCCGACTTCCA CTGAGGAA | 248 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_008_GFP-N_F07.ab1 | GTSESATPESGPGSE PATSGSETPGTSTEP SEGSAP | 249 | GGTACTTCTGAAAGCGCAACCCCTG AATCCGGTCCAGGTAGCGAACCGGC TACTTCTGGCTCTGAGACTCCAGGTA CTTCTACCGAACCGTCCGAAGGTAG CGCACCA | 250 |
| LCW0402_009_GFP-N_G07.ab1 | GSPAGSPTSTEEGSP AGSPTSTEEGSEPAT SGSETP | 251 | GGTAGCCCGGCTGGCTCTCCAACCT CCACTGAGGAAGGTAGCCCGGCTGG CTCTCCAACCTCCACTGAAGAAGGT AGCGAACCGGCTACCTCCGGCTCTG AAACTCCA | 252 |
| LCW0402_011_GFP-N_A08.ab1 | GSPAGSPTSTEEGTS ESATPESGPGTSTEP SEGSAP | 253 | GGTAGCCCGGCTGGCTCTCCTACCTC TACTGAGGAAGGTACTTCTGAAAGC GCTACTCCTGAGTCTGGTCCAGGTA CCTCTACTGAACCGTCCGAAGGTAG CGCTCCA | 254 |
| LCW0402_012_GFP-N_B08.ab1 | GSPAGSPTSTEEGSP AGSPTSTEEGTSTEP SEGSAP | 255 | GGTAGCCCGCTGGCTCTCCGACTTC TACTGAGGAAGGTAGCCCGGCTGGT TCTCCGACTTCTACTGAGGAAGGTA CTTCTACCGAACCTTCCGAAGGTAG CGCTCCA | 256 |
| LCW0402_013_GFP-N_C08.ab1 | GTSESATPESGPGTS TEPSEGSAPGTSTEP SEGSAP | 257 | GGTACTTCTGAAAGCGCTACTCCGG AGTCCGGTCCAGGTACCTCTACCGA ACCGTCCGAAGGCAGCGCTCCAGGT ACTTCTACTGAACCTTCTGAGGGTA GCGCTCCA | 258 |
| LCW0402_014_GFP-N_D08.ab1 | GTSTEPSEGSAPGSP AGSPTSTEEGTSTEP SEGSAP | 259 | GGTACCTCTACCGAACCTTCCGAAG GTAGCGCTCCAGGTAGCCCCGGCAGG TTCTCCTACTTCCACTGAGGAAGGTA CTTCTACCGAACCTTCTGAGGGTAG CGCACCA | 260 |
| LCW0402_015_GFP-N_E08.ab1 | GSEPATSGSETPGSP AGSPTSTEEGTSESA TPESGP | 261 | GGTAGCGAACCGGCTACTTCCGGCT CTGAGACTCCAGGTAGCCCTGCTGG CTCTCCGACCTCTACCGAAGAAGGT ACCTCTGAAAGCGCTACCCCTGAGT CTGGCCCA | 262 |
| LCW0402_016_GFP-N_F08.ab1 | GTSTEPSEGSAPGTS ESATPESGPGTSESA TPESGP | 263 | GGTACTTCTACCGAACCTTCCGAGG GCAGCGCACCAGGTACTTCTGAAAG CGCTACCCCTGAGTCCGGCCCAGGT ACTTCTGAAAGCGCTACTCCTGAAT CCGGTCCA | 264 |
| LCW0402_020_GFP-N_G08.ab1 | GTSTEPSEGSAPGSE PATSGSETPGSPAGS PTSTEE | 265 | GGTACTTCTACTGAACCGTCTGAAG GCAGCGCACCAGGTAGCGAACCGGC TACTTCCGGTTCTGAAACCCCAGGT AGCCCAGCAGGTTCTCCAACTTCTA CTGAAGAA | 266 |
| LCW0402_023_GFP-N_A09.ab1 | GSPAGSPTSTEEGTS ESATPESGPGSEPAT SGSETP | 267 | GGTAGCCCTGCTGGCTCTCCAACCTC CACCGAAGAAGGTACCTCTGAAAGC GCAACCCCTGAATCCGGCCCAGGTA GCGAACCGGCAACCTCCGGTTCTGA AACCCCA | 268 |
| LCW0402_024_GFP-N_B09.ab1 | GTSESATPESGPGSP AGSPTSTEEGSPAGS PTSTEE | 269 | GGTACTTCTGAAAGCGCTACTCCTG AGTCCGGCCCAGGTAGCCCGGCTGG CTCTCCGACTTCCACCGAGGAAGGT AGCCCGGCTGGCTCTCCAACTTCTAC TGAAGAA | 270 |
| LCW0402_025_GFP-N_C09.ab1 | GTSTEPSEGSAPGTS ESATPESGPGTSTEP SEGSAP | 271 | GGTACCTCTACTGAACCTTCTGAGG GCAGCGCTCCAGGTACTTCTGAAAG CGCTACCCCGGAGTCCGGTCCAGGT ACTTCTACTGAACCGTCCGAAGGTA GCGCACCA | 272 |
| LCW0402_026_GFP-N_D09.ab1 | GSPAGSPTSTEEGTS TEPSEGSAPGSEPAT SGSETP | 273 | GGTAGCCCGGCAGGCTCTCCGACTT CCACCGAGGAAGGTACCTCTACTGA ACCTTCTGAGGGTAGCGCTCCAGGT | 274 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| | | | AGCGAACCGGCAACCTCTGGCTCTG AAACCCCA | |
| LCW0402_027_GFP-N_E09.ab1 | GSPAGSPTSTEEGTS TEPSEGSAPGTSTEP SEGSAP | 275 | GGTAGCCCAGCAGGCTCTCCGACTT CCACTGAGGAAGGTACTTCTACTGA ACCTTCCGAAGGCAGCGCACCAGGT ACCTCTACTGAACCTTCTGAGGGCA GCGCTCCA | 276 |
| LCW0402_032_GFP-N_H09.ab1 | GSEPATSGSETPGTS ESATPESGPGSPAGS PTSTEE | 277 | GGTAGCGAACCTGCTACCTCCGGTT CTGAAACCCCAGGTACCTCTGAAAG CGCAACTCCGGAGTCTGGTCCAGGT AGCCCTGCAGGTTCTCCTACCTCCAC TGAGGAA | 278 |
| LCW0402_034_GFP-N_A10.ab1 | GTSESATPESGPGTS TEPSEGSAPGTSTEP SEGSAP | 279 | GGTACCTCTGAAAGCGCTACTCCGG AGTCTGGCCCAGGTACCTCTACTGA ACCGTCTGAGGGTAGCGCTCCAGGT ACTTCTACTGAACCGTCCGAAGGTA GCGCACCA | 280 |
| LCW0402_036_GFP-N_C10.ab1 | GSPAGSPTSTEEGTS TEPSEGSAPGTSTEP SEGSAP | 281 | GGTAGCCCGGCTGGTTCTCCGACTTC CACCGAGGAAGGTACCTCTACTGAA CCTTCTGAGGGTAGCGCTCCAGGTA CCTCTACTGAACCTTCCGAAGGCAG CGCTCCA | 282 |
| LCW0402_039_GFP-N_E10.ab1 | GTSTEPSEGSAPGTS TEPSEGSAPGTSTEP SEGSAP | 283 | GGTACTTCTACCGAACCGTCCGAGG GCAGCGCTCCAGGTACTTCTACTGA ACCTTCTGAAGGCAGCGCTCCAGGT ACTTCTACTGAACCTTCCGAAGGTA GCGCACCA | 284 |
| LCW0402_040_GFP-N_F10.ab1 | GSEPATSGSETPGTS ESATPESGPGTSTEP SEGSAP | 285 | GGTAGCGAACCTGCAACCTCTGGCT CTGAAACCCCAGGTACCTCTGAAAG CGCTACTCCTGAATCTGGCCCAGGT ACTTCTACTGAACCGTCCGAGGGCA GCGCACCA | 286 |
| LCW0402_041_GFP-N_G10.ab1 | GTSTEPSEGSAPGSP AGSPTSTEEGTSTEP SEGSAP | 287 | GGTACTTCTACCGAACCGTCCGAGG GTAGCGCACCAGGTAGCCCAGCAGG TTCTCCTACCTCCACCGAGGAAGGT ACTTCTACCGAACCGTCCGAGGGTA GCGCACCA | 288 |
| LCW0402_050_GFP-N_A11.ab1 | GSEPATSGSETPGTS ESATPESGPGSEPAT SGSETP | 289 | GGTAGCGAACCGGCAACCTCCGGCT CTGAAACTCCAGGTACTTCTGAAAG CGCTACTCCGGAATCCGGCCCAGGT AGCGAACCGGCTACTTCCGGCTCTG AAACCCCA | 290 |
| LCW0402_051_GFP-N_B11.ab1 | GSEPATSGSETPGTS ESATPESGPGSEPAT SGSETP | 291 | GGTAGCGAACCGGCAACTTCCGGCT CTGAAACCCCAGGTACTTCTGAAAG CGCTACTCCTGAGTCTGGCCCAGGT AGCGAACCTGCTACCTCTGGCTCTG AAACCCCA | 292 |
| LCW0402_059_GFP-N_E11.ab1 | GSEPATSGSETPGSE PATSGSETPGTSTEP SEGSAP | 293 | GGTAGCGAACCGGCAACCTCTGGCT CTGAAACTCCAGGTAGCGAACCTGC AACCTCCGGCTCTGAAACCCCAGGT ACTTCTACTGAACCTTCTGAGGGCA GCGCACCA | 294 |
| LCW0402_060_GFP-N_F11.ab1 | GTSESATPESGPGSE PATSGSETPGSEPAT SGSETP | 295 | GGTACTTCTGAAAGCGCTACCCCGG AATCTGGCCCAGGTAGCGAACCGGC TACTTCTGGTTCTGAAACCCCAGGTA GCGAACCGGCTACCTCCGGTTCTGA AACTCCA | 296 |
| LCW0402_061_GFP-N_G11.ab1 | GTSTEPSEGSAPGTS TEPSEGSAPGTSESA TPESGP | 297 | GGTACCTCTACTGAACCTTCCGAAG GCAGCGCTCCAGGTACCTCTACCGA ACCGTCCGAGGGCAGCGCACCAGGT ACTTCTGAAAGCGCAACCCCTGAAT CCGGTCCA | 298 |

TABLE 9-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_065_GFP-N_A12.ab1 | GSEPATSGSETPGTS ESATPESGPGTSESA TPESGP | 299 | GGTAGCGAACCGGCAACCTCTGGCT CTGAAACCCCAGGTACCTCTGAAAG CGCTACTCCGGAATCTGGTCCAGGT ACTTCTGAAAGCGCTACTCCGGAAT CCGGTCCA | 300 |
| LCW0402_066_GFP-N_B12.ab1 | GSEPATSGSETPGSE PATSGSETPGTSTEP SEGSAP | 301 | GGTAGCGAACCTGCTACCTCCGGCT CTGAAACTCCAGGTAGCGAACCGGC TACTTCCGGTTCTGAAACTCCAGGTA CCTCTACCGAACCTTCCGAAGGCAG CGCACCA | 302 |
| LCW0402_067_GFP-N_C12.ab1 | GSEPATSGSETPGTS TEPSEGSAPGSEPAT SGSETP | 303 | GGTAGCGAACCTGCTACTTCTGGTTC TGAAACTCCAGGTACTTCTACCGAA CCGTCCGAGGGTAGCGCTCCAGGTA GCGAACCTGCTACTTCTGGTTCTGAA ACTCCA | 304 |
| LCW0402_069_GFP-N_D12.ab1 | GTSTEPSEGSAPGTS TEPSEGSAPGSEPAT SGSETP | 305 | GGTACCTCTACCGAACCGTCCGAGG GTAGCGCACCAGGTACCTCTACTGA ACCGTCTGAGGGTAGCGCTCCAGGT AGCGAACCGGCAACCTCCGGTTCTG AAACTCCA | 306 |
| LCW0402_073_GFP-N_F12.ab1 | GTSTEPSEGSAPGSE PATSGSETPGSPAGS PTSTEE | 307 | GGTACTTCTACTGAACCTTCCGAAG GTAGCGCTCCAGGTAGCGAACCTGC TACTTCTGGTTCTGAAACCCCAGGTA GCCCGGCTGGCTCTCCGACCTCCAC CGAGGAA | 308 |
| LCW0402_074_GFP-N_G12.ab1 | GSEPATSGSETPGSP AGSPTSTEEGTSESA TPESGP | 309 | GGTAGCGAACCGGCTACTTCCGGCT CTGAGACTCCAGGTAGCCCAGCTGG TTCTCCAACCTCTACTGAGGAAGGT ACTTCTGAAAGCGCTACCCCTGAAT CTGGTCCA | 310 |
| LCW0402_075_GFP-N_H12.ab1 | GTSESATPESGPGSE PATSGSETPGTSESA TPESGP | 311 | GGTACCTCTGAAAGCGCAACTCCTG AGTCTGGCCCAGGTAGCGAACCTGC TACCTCCGGCTCTGAGACTCCAGGT ACCTCTGAAAGCGCAACCCCGGAAT CTGGTCCA | 312 |

Example 3

Construction of XTEN_AF36 Segments

A codon library encoding sequences of 36 amino acid length was constructed. The sequences were designated XTEN_AF36. Its segments have the amino acid sequence [α]3 where X is a 12 mer peptide with the sequence: GSTSESPSGTAP (SEQ ID NO: 313), GTSTPESGSASP (SEQ ID NO: 314), GTSPSGESSTAP (SEQ ID NO: 315), or GSTSSTAESPGP (SEQ ID NO: 316). The insert was obtained by annealing the following pairs of phosphorylated synthetic oligonucleotide pairs:

AF1for:
(SEQ ID NO: 317)
AGGTTCTACYAGCGAATCYCCKTCTGGYACYGCWCC

AF1rev:
(SEQ ID NO: 318)
ACCTGGWGCRGTRCCAGAMGGRGATTCGCTRGTAGA

AF2for:
(SEQ ID NO: 319)
AGGTACYTCTACYCCKGAAAGCGGYTCYGCWTCTCC

AF2rev:
(SEQ ID NO: 320)
ACCTGGAGAWGCRGARCCGCTTTCMGGRGTAGARGT

AF3for:
(SEQ ID NO: 321)
AGGTACYTCYCCKAGCGGYGAATCTTCTACYGCWCC

AF3rev:
(SEQ ID NO: 322)
ACCTGGWGCRGTAGAAGATTCRCCGCTMGGRGARGT

AF4for:
(SEQ ID NO: 323)
AGGTTCYACYAGCTCTACYGCWGAATCTCCKGGYCC

AF4rev:
(SEQ ID NO: 324)
ACCTGGRCCMGGAGATTCWGCRGTAGAGCTRGTRGA

We also annealed the phosphorylated oligonucleotide 3 KpnIstopperFor: AGGTTCGTCTTCACTCGAGGGTAC (SEQ ID NO: 325) and the non-phosphorylated oligonucleotide pr_3 KpnIstopperRev: CCTCGAGTGAAGACGA (SEQ ID NO: 326). The annealed oligonucleotide pairs were ligated, which resulted in a mixture of products with varying length that represents the varying number of 12 mer repeats ligated to one BbsI/KpnI segment The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs for these segments are listed in Table 10.

TABLE 10

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTSPSGESSTAPGTSPSGESSTAP | 327 | GGTACTTCTACTCCGGAAAGCGGTTCCGCATCTCCAGGTACTTCTCCTAGCGGTGAATCTTCTACTGCTCCAGGTACCTCTCCTAGCGGCGAATCTTCTACTGCTCCA | 328 |
| LCW0403_005_GFP-N_B01.ab1 | GTSPSGESSTAPGSTSSTAESPGPGTSPSGESSTAP | 329 | GGTACTTCTCCGAGCGGTGAATCTTCTACCGCACCAGGTTCTACTAGCTCTACCGCTGAATCTCCGGGCCCAGGTACTTCTCCGAGCGGTGAATCTTCTACTGCTCCA | 330 |
| LCW0403_006_GFP-N_C01.ab1 | GSTSSTAESPGPGTSPSGESSTAPGTSTPESGSASP | 331 | GGTTCCACCAGCTCTACTGCTGAATCTCCTGGTCCAGGTACCTCTCCTAGCGGTGAATCTTCTACTGCTCCAGGTACTTCTACTCCTGAAAGCGGCTCTGCTTCTCCA | 332 |
| LCW0403_007_GFP-N_D01.ab1 | GSTSSTAESPGPGSTSSTAESPGPGTSPSGESSTAP | 333 | GGTTCTACCAGCTCTACTGCAGAATCTCCTGGCCCAGGTTCCACCAGCTCTACCGCAGAATCTCCGGGTCCAGGTACTTCCCCTAGCGGTGAATCTTCTACCGCACCA | 334 |
| LCW0403_008_GFP-N_E01.ab1 | GSTSSTAESPGPGTSPSGESSTAPGTSTPESGSASP | 335 | GGTTCTACTAGCTCTACTGCTGAATCTCCTGGCCCAGGTACTTCTCCTAGCGGTGAATCTTCTACCGCTCCAGGTACCTCTACTCCGGAAAGCGGTTCTGCATCTCCA | 336 |
| LCW0403_010_GFP-N_F01.ab1 | GSTSSTAESPGPGTSTPESGSASPGSTSESPSGTAP | 337 | GGTTCTACCAGCTCTACCGCAGAATCTCCTGGTCCAGGTACCTCTACTCCGGAAAGCGGCTCTGCATCTCCAGGTTCTACTAGCGAATCTCCTTCTGGCACTGCACCA | 338 |
| LCW0403_011_GFP-N_G01.ab1 | GSTSSTAESPGPGTSTPESGSASPGTSTPESGSASP | 339 | GGTTCTACTAGCTCTACTGCAGAATCTCCTGGCCCAGGTACCTCTACTCCGGAAAGCGGCTCTGCATCTCCAGGTACTTCTACCCCTGAAAGCGGTTCTGCATCTCCA | 340 |
| LCW0403_012_GFP-N_H01.ab1 | GSTSESPSGTAPGTSPSGESSTAPGSTSESPSGTAP | 341 | GGTTCTACCAGCGAATCTCCTTCTGGCACCGCTCCAGGTACCTCTCCTAGCGGCGAATCTTCTACCGCTCCAGGTTCTACTAGCGAATCTCCTTCTGGCACTGCACCA | 342 |
| LCW0403_013_GFP-N_A02.ab1 | GSTSSTAESPGPGSTSSTAESPGPGTSPSGESSTAP | 343 | GGTTCCACCAGCTCTACTGCAGAATCTCCGGGCCCAGGTTCTACTAGCTCTACTGCAGAATCTCCGGGTCCAGGTACTTCTCCTAGCGGCGAATCTTCTACCGCTCCA | 344 |
| LCW0403_014_GFP-N_B02.ab1 | GSTSSTAESPGPGTSTPESGSASPGSTSESPSGTAP | 345 | GGTTCCACTAGCTCTACTGCAGAATCTCCTGGCCCAGGTACCTCTACCCCTGAAAGCGGCTCTGCATCTCCAGGTTCTACCAGCGAATCCCGTCTGGCACCGCACCA | 346 |
| LCW0403_015_GFP-N_C02.ab1 | GSTSSTAESPGPGSTSSTAESPGPGTSPSGESSTAP | 347 | GGTTCTACTAGCTCTACTGCTGAATCTCCGGGTCCAGGTTCTACCAGCTCTACTGCTGAATCTCCTGGTCCAGGTACC | 348 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| | | | TCCCCGAGCGGTGAATCTTCTACTGC ACCA | |
| LCW0403_017_GFP-N_D02.ab1 | GSTSSTAESPGPGSTS ESPSGTAPGSTSSTAE SPGP | 349 | GGTTCTACCAGCTCTACCGCTGAATC TCCTGGCCCAGGTTCTACCAGCGAA TCCCCGTCTGGCACCGCACCAGGTT CTACTAGCTCTACCGCTGAATCTCCG GGTCCA | 350 |
| LCW0403_018_GFP-N_E02.ab1 | GSTSSTAESPGPGSTS STAESPGPGSTSSTAE SPGP | 351 | GGTTCTACCAGCTCTACCGCAGAAT CTCCTGGCCCAGGTTCCACTAGCTCT ACCGCTGAATCTCCTGGTCCAGGTTC TACTAGCTCTACCGCTGAATCTCCTG GTCCA | 352 |
| LCW0403_019_GFP-N_F02.ab1 | GSTSESPSGTAPGSTS STAESPGPGSTSSTAE SPGP | 353 | GGTTCTACTAGCGAATCCCCTTCTGG TACTGCTCCAGGTTCCACTAGCTCTA CCGCTGAATCTCCTGGCCCAGGTTCC ACTAGCTCTACTGCAGAATCTCCTG GTCCA | 354 |
| LCW0403_023_GFP-N_H02.ab1 | GSTSESPSGTAPGSTS ESPSGTAPGSTSESPS GTAP | 355 | GGTTCTACTAGCGAATCTCCTTCTGG TACCGCTCCAGGTTCTACCAGCGAA TCCCCGTCTGGTACTGCTCCAGGTTC TACCAGCGAATCTCCTTCTGGTACTG CACCA | 356 |
| LCW0403_024_GFP-N_A03.ab1 | GSTSSTAESPGPGSTS STAESPGPGSTSSTAE SPGP | 357 | GGTTCCACCAGCTCTACTGCTGAATC TCCTGGCCCAGGTTCTACCAGCTCTA CTGCTGAATCTCCGGGCCCAGGTTC CACCAGCTCTACCGCTGAATCTCCG GGTCCA | 358 |
| LCW0403_025_GFP-N_B03.ab1 | GSTSSTAESPGPGSTS STAESPGPGTSPSGES STAP | 359 | GGTTCCACTAGCTCTACCGCAGAAT CTCCTGGTCCAGGTTCTACTAGCTCT ACTGCTGAATCTCCGGGTCCAGGTA CCTCCCCTAGCGGCGAATCTTCTACC GCTCCA | 360 |
| LCW0403_028_GFP-N_D03.ab1 | GSSPSASTGTGPGSST PSGATGSPGSSTPSGA TGSP | 361 | GGTTCTAGCCCTTCTGCTTCCACCGG TACCGGCCCAGGTAGCTCTACTCCG TCTGGTGCAACTGGCTCTCCAGGTA GCTCTACTCCGTCTGGTGCAACCGG CTCCCCA | 362 |
| LCW0403_029_GFP-N_E03.ab1 | GTSPSGESSTAPGTST PESGSASPGSTSSTAE SPGP | 363 | GGTACTTCCCCTAGCGGTGAATCTTC TACTGCTCCAGGTACCTCTACTCCGG AAAGCGGCTCCGCATCTCCAGGTTC TACTAGCTCTACTGCTGAATCTCCTG GTCCA | 364 |
| LCW0403_030_GFP-N_F03.ab1 | GSTSSTAESPGPGSTS STAESPGPGTSTPESG SASP | 365 | GGTTCTACTAGCTCTACCGCTGAATC TCCGGGTCCAGGTTCTACCAGCTCTA CTGCAGAATCTCCTGGCCCAGGTAC TTCTACTCCGGAAAGCGGTTCCGCTT CTCCA | 366 |
| LCW0403_031_GFP-N_G03.ab1 | GTSPSGESSTAPGSTS STAESPGPGTSTPESG SASP | 367 | GGTACTTCTCCTAGCGGTGAATCTTC TACCGCTCCAGGTTCTACCAGCTCTA CTGCTGAATCTCCTGGCCCAGGTACT TCTACCCCGGAAAGCGGCTCCGCTT CTCCA | 368 |
| LCW0403_033_GFP-N_H03.ab1 | GSTSESPSGTAPGSTS STAESPGPGSTSSTAE SPGP | 369 | GGTTCTACTAGCGAATCCCCTTCTGG TACTGCACCAGGTTCTACCAGCTCTA CTGCTGAATCTCCGGGCCCAGGTTC CACCAGCTCTACCGCAGAATCTCCT GGTCCA | 370 |
| LCW0403_035_GFP-N_A04.ab1 | GSTSSTAESPGPGSTS ESPSGTAPGSTSSTAE SPGP | 371 | GGTTCCACCAGCTCTACCGCTGAAT CTCCGGGCCCAGGTTCTACCAGCGA ATCCCCTTCTGGCACTGCACCAGGTT CTACTAGCTCTACCGCAGAATCTCC GGGCCCA | 372 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_036_GFP-N_B04.ab1 | GSTSSTAESPGPGTSP SGESSTAPGTSTPESG SASP | 373 | GGTTCTACCAGCTCTACTGCTGAATC TCCGGGTCCAGGTACTTCCCCGAGC GGTGAATCTTCTACTGCACCAGGTA CTTCTACTCCGGAAAGCGGTTCCGCT TCTCCA | 374 |
| LCW0403_039_GFP-N_C04.ab1 | GSTSESPSGTAPGSTS ESPSGTAPGTSPSGES STAP | 375 | GGTTCTACCAGCGAATCTCCTTCTGG CACCGCTCCAGGTTCTACTAGCGAA TCCCCGTCTGGTACCGCACCAGGTA CTTCTCCTAGCGGCGAATCTTCTACC GCACCA | 376 |
| LCW0403_041_GFP-N_D04.ab1 | GSTSESPSGTAPGSTS ESPSGTAPGTSTPESG SASP | 377 | GGTTCTACCAGCGAATCCCCTTCTGG TACTGCTCCAGGTTCTACCAGCGAA TCCCCTTCTGGCACCGCACCAGGTA CTTCTACCCCTGAAAGCGGCTCCGCT TCTCCA | 378 |
| LCW0403_044_GFP-N_E04.ab1 | GTSTPESGSASPGSTS STAESPGPGSTSSTAE SPGP | 379 | GGTACCTCTACTCCTGAAAGCGGTT CTGCATCTCCAGGTTCCACTAGCTCT ACCGCAGAATCTCCGGGCCCAGGTT CTACTAGCTCTACTGCTGAATCTCCT GGCCCA | 380 |
| LCW0403_046_GFP-N_F04.ab1 | GSTSESPSGTAPGSTS ESPSGTAPGTSPSGES STAP | 381 | GGTTCTACCAGCGAATCCCCTTCTGG CACTGCACCAGGTTCTACTAGCGAA TCCCCTTCTGGTACCGCACCAGGTAC TTCTCCGAGCGGCGAATCTTCTACTG CTCCA | 382 |
| LCW0403_047_GFP-N_G04.ab1 | GSTSSTAESPGPGSTS STAESPGPGSTSESPS GTAP | 383 | GGTTCTACTAGCTCTACCGCTGAATC TCCTGGCCCAGGTTCCACTAGCTCTA CCGCAGAATCTCCGGGCCCAGGTTC TACTAGCGAATCCCCTTCTGGTACCG CTCCA | 384 |
| LCW0403_049_GFP-N_H04.ab1 | GSTSSTAESPGPGSTS STAESPGPGTSTPESG SASP | 385 | GGTTCCACCAGCTCTACTGCAGAAT CTCCTGGCCCAGGTTCTACTAGCTCT ACCGCAGAATCTCCTGGTCCAGGTA CCTCTACTCCTGAAAGCGGTTCCGC ATCTCCA | 386 |
| LCW0403_051_GFP-N_A05.ab1 | GSTSSTAESPGPGSTS STAESPGPGSTSESPS GTAP | 387 | GGTTCTACTAGCTCTACTGCTGAATC TCCGGGCCCAGGTTCTACTAGCTCTA CCGCTGAATCTCCGGGTCCAGGTTCT ACTAGCGAATCTCCTTCTGGTACCGC TCCA | 388 |
| LCW0403_053_GFP-N_B05.ab1 | GTSPSGESSTAPGSTS ESPSGTAPGSTSSTAE SPGP | 389 | GGTACCTCCCCGAGCGGTGAATCTT CTACTGCACCAGGTTCTACTAGCGA ATCCCCTTCTGGTACTGCTCCAGGTT CCACCAGCTCTACTGCAGAATCTCC GGGTCCA | 390 |
| LCW0403_054_GFP-N_C05.ab1 | GSTSESPSGTAPGTSP SGESSTAPGSTSSTAE SPGP | 391 | GGTTCTACTAGCGAATCCCCGTCTG GTACTGCTCCAGGTACTTCCCCTAGC GGTGAATCTTCTACTGCTCCAGGTTC TACCAGCTCTACCGCAGAATCTCCG GGTCCA | 392 |
| LCW0403_057_GFP-N_D05.ab1 | GSTSSTAESPGPGSTS ESPSGTAPGTSPSGES STAP | 393 | GGTTCTACCAGCTCTACCGCTGAATC TCCTGGCCCAGGTTCTACTAGCGAA TCTCCGTCTGGCACCGCACCAGGTA CTTCCCCTAGCGGTGAATCTTCTACT GCACCA | 394 |
| LCW0403_058_GFP-N_E05.ab1 | GSTSESPSGTAPGSTS ESPSGTAPGTSTPESG SASP | 395 | GGTTCTACTAGCGAATCTCCTTCTGG CACTGCACCAGGTTCTACCAGCGAA TCTCCGTCTGGCACTGCACCAGGTA CCTCTACCCCTGAAAGCGGTTCCGCT TCTCCA | 396 |
| LCW0403_060_GFP-N_F05.ab1 | GTSTPESGSASPGSTS ESPSGTAPGSTSSTAE SPGP | 397 | GGTACCTCTACTCCGGAAAGCGGTT CCGCATCTCCAGGTTCTACCAGCGA ATCCCCGTCTGGCACCGCACCAGGT | 398 |

TABLE 10-continued

DNA and Amino Acid Sequences for 36-mer motifs

| File name | Amino acid sequence | SEQ ID NO: | Nucleotide sequence | SEQ ID NO: |
|---|---|---|---|---|
| | | | TCTACTAGCTCTACTGCTGAATCTCC GGGCCCA | |
| LCW0403_063_GFP-N_G05.ab1 | GSTSSTAESPGPGTSP SGESSTAPGTSPSGES STAP | 399 | GGTTCTACTAGCTCTACTGCAGAATC TCCGGGCCCAGGTACCTCTCCTAGC GGTGAATCTTCTACCGCTCCAGGTA CTTCTCCGAGCGGTGAATCTTCTACC GCTCCA | 400 |
| LCW0403_064_GFP-N_H05.ab1 | GTSPSGESSTAPGTSP SGESSTAPGTSPSGES STAP | 401 | GGTACCTCCCCTAGCGGCGAATCTT CTACTGCTCCAGGTACCTCTCCTAGC GGCGAATCTTCTACCGCTCCAGGTA CCTCCCCTAGCGGTGAATCTTCTACC GCACCA | 402 |
| LCW0403_065_GFP-N_A06.ab1 | GSTSSTAESPGPGTST PESGSASPGSTSESPS GTAP | 403 | GGTTCCACTAGCTCTACTGCTGAATC TCCTGGCCCAGGTACTTCTACTCCGG AAAGCGGTTCCGCTTCTCCAGGTTCT ACTAGCGAATCTCCGTCTGGCACCG CACCA | 404 |
| LCW0403_066_GFP-N_B06.ab1 | GSTSESPSGTAPGTSP SGESSTAPGTSPSGES STAP | 405 | GGTTCTACTAGCGAATCTCCGTCTGG CACTGCTCCAGGTACTTCTCCTAGCG GTGAATCTTCTACCGCTCCAGGTACT TCCCCTAGCGGCGAATCTTCTACCGC TCCA | 406 |
| LCW0403_067_GFP-N_C06.ab1 | GSTSESPSGTAPGTST PESGSASPGSTSSTAE SPGP | 407 | GGTTCTACTAGCGAATCTCCTTCTGG TACCGCTCCAGGTACTTCTACCCCTG AAAGCGGCTCCGCTTCTCCAGGTTC CACTAGCTCTACCGCTGAATCTCCG GGTCCA | 408 |
| LCW0403_068_GFP-N_D06.ab1 | GSTSSTAESPGPGSTS STAESPGPGSTSESPS GTAP | 409 | GGTTCCACTAGCTCTACTGCTGAATC TCCTGGCCCAGGTTCTACCAGCTCTA CCGCTGAATCTCCTGGCCCAGGTTCT ACCAGCGAATCTCCGTCTGGCACCG CACCA | 410 |
| LCW0403_069_GFP-N_E06.ab1 | GSTSESPSGTAPGTST PESGSASPGTSTPESG SASP | 411 | GGTTCTACTAGCGAATCCCCGTCTG GTACCGCACCAGGTACTTCTACCCC GGAAAGCGGCTCTGCTTCTCCAGGT ACTTCTACCCCGGAAAGCGGCTCCG CATCTCCA | 412 |
| LCW0403_070_GFP-N_F06.ab1 | GSTSESPSGTAPGTST PESGSASPGTSTPESG SASP | 413 | GGTTCTACTAGCGAATCCCCGTCTG GTACTGCTCCAGGTACTTCTACTCCT GAAAGCGGTTCCGCTTCTCCAGGTA CCTCTACTCCGGAAAGCGGTTCTGC ATCTCCA | 414 |

Example 4

Construction of XTEN_AG36 Segments

A codon library encoding sequences of 36 amino acid length was constructed. The sequences were designated XTEN_AG36. Its segments have the amino acid sequence [α]$_3$ where X is a 12 mer peptide with the sequence: GTPGS-GTASSSP (SEQ ID NO: 415), GSSTPSGATGSP (SEQ ID NO: 416), GSSPSASTGTGP (SEQ ID NO: 417), or GASPGTSSTGSP (SEQ ID NO: 418). The insert was obtained by annealing the following pairs of phosphorylated synthetic oligonucleotide pairs:

AG1for:
(SEQ ID NO: 419)
AGGTACYCCKGGYAGCGGTACYGCWTCTTCYTCTCC

AG1rev:
(SEQ ID NO: 420)
ACCTGGAGARGAAGAWGCRGTACCGCTRCCMGGRGT

AG2for:
(SEQ ID NO: 421)
AGGTAGCTCTACYCCKTCTGGTGCWACYGGYTCYCC

AG2rev:
(SEQ ID NO: 422)
ACCTGGRGARCCRGTWGCACCAGAMGGRGTAGAGCT

AG3for:
(SEQ ID NO: 423)
AGGTTCTAGCCCKTCTGCWTCYACYGGTACYGGYCC

AG3rev:
(SEQ ID NO: 424)
ACCTGGRCCRGTACCRGTRGAWGCAGAMGGGCTAGA

```
AG4for:
                                       (SEQ ID NO: 425)
AGGTGCWTCYCCKGGYACYAGCTCTACYGGTTCTCC AG4rev:
                                       (SEQ ID NO: 426)
ACCTGGAGAACCRGTAGAGCTRGTRCCMGGRGAWGC
```

We also annealed the phosphorylated oligonucleotide 3 KpnIstopperFor: AGGTTCGTCTTCACTCGAGGGTAC (SEQ ID NO: 427) and the non-phosphorylated oligonucleotide pr_3 KpnIstopperRev: CCTCGAGTGAAGACGA (SEQ ID NO: 428). The annealed oligonucleotide pairs were ligated, which resulted in a mixture of products with varying length that represents the varying number of 12 mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs for these segments are listed in Table 11.

TABLE 11

DNA and Amino Acid Sequences for 36-mer motifs

| File name | Amino acid sequence | SEQ ID NO: | Nucleotide sequence | SEQ ID NO: |
|---|---|---|---|---|
| LCW0404_001_GFP-N_A07.ab1 | GASPGTSSTGSPGTPG SGTASSSPGSSTPSGA TGSP | 429 | GGTGCATCCCCGGGCACTAGCTCTACC GGTTCTCCAGGTACTCCTGGTAGCGGT ACTGCTTCTTCTTCTCCAGGTAGCTCTA CTCCTTCTGGTGCTACTGGTTCTCCA | 430 |
| LCW0404_003_GFP-N_B07.ab1 | GSSTPSGATGSPGSSP SASTGTGPGSSTPSGA TGSP | 431 | GGTAGCTCTACCCCTTCTGGTGCTACC GGCTCTCCAGGTTCTAGCCCGTCTGCTT CTACCGGTACCGGTCCAGGTAGCTCTA CCCCTTCTGGTGCTACTGGTTCTCCA | 432 |
| LCW0404_006_GFP-N_C07.ab1 | GASPGTSSTGSPGSSP SASTGTGPGSSTPSGA TGSP | 433 | GGTGCATCTCCGGGTACTAGCTCTACC GGTTCTCCAGGTTCTAGCCCTTCTGCTT CCACTGGTACCGGCCCAGGTAGCTCTA CCCCGTCTGGTGCTACTGGTTCCCCA | 434 |
| LCW0404_007_GFP-N_D07.ab1 | GTPGSGTASSSPGSST PSGATGSPGASPGTSS TGSP | 435 | GGTACTCCGGGCAGCGGTACTGCTTCT TCCTCTCCAGGTAGCTCTACCCCTTCTG GTGCAACTGGTTCCCCAGGTGCATCCC CTGGTACTAGCTCTACCGGTTCTCCA | 436 |
| LCW0404_009_GFP-N_E07.ab1 | GTPGSGTASSSPGASP GTSSTGSPGSRPSAST GTGP | 437 | GGTACCCCTGGCAGCGGTACTGCTTCT TCTTCTCCAGGTGCTTCCCCTGGTACCA GCTCTACCGGTTCTCCAGGTTCTAGAC CTTCTGCATCCACCGGTACTGGTCCA | 438 |
| LCW0404_011_GFP-N_F07.ab1 | GASPGTSSTGSPGSST PSGATGSPGASPGTSS TGSP | 439 | GGTGCATCTCCTGGTACCAGCTCTACC GGTTCTCCAGGTAGCTCTACTCCTTCTG GTGCTACTGGCTCTCCAGGTGCTTCCC CGGGTACCAGCTCTACCGGTTCTCCA | 440 |
| LCW0404_012_GFP-N_G07.ab1 | GTPGSGTASSSPGSST PSGATGSPGSSTPSGA TGSP | 441 | GGTACCCCGGGCAGCGGTACCGCATCT TCCTCTCCAGGTAGCTCTACCCCGTCTG GTGCTACCGGTTCCCCAGGTAGCTCTA CCCCGTCTGGTGCAACCGGCTCCCCA | 442 |
| LCW0404_014_GFP-N_H07.ab1 | GASPGTSSTGSPGASP GTSSTGSPGASPGTSS TGSP | 443 | GGTGCATCTCCGGGCACTAGCTCTACT GGTTCTCCAGGTGCATCCCCTGGCACT AGCTCTACTGGTTCTCCAGGTGCTTCTC CTGGTACCAGCTCTACTGGTTCTCCA | 444 |
| LCW0404_015_GFP-N_A08.ab1 | GSSTPSGATGSPGSSP SASTGTGPGASPGTSS TGSP | 445 | GGTAGCTCTACTCCGTCTGGTGCAACC GGCTCCCCAGGTTCTAGCCCGTCTGCT TCCACTGGTACTGGCCCAGGTGCTTCC CCGGGCACCAGCTCTACTGGTTCTCCA | 446 |
| LCW0404_016_GFP-N_B08.ab1 | GSSTPSGATGSPGSST PSGATGSPGTPGSGT ASSSP | 447 | GGTAGCTCTACTCCTTCTGGTGCTACC GGTTCCCCAGGTAGCTCTACTCCTTCTG GTGCTACTGGTTCCCCAGGTACTCCGG GCAGCGGTACTGCTTCTTCCTCTCCA | 448 |
| LCW0404_017_GFP-N_C08.ab1 | GSSTPSGATGSPGSST PSGATGSPGASPGTSS | 449 | GGTAGCTCTACTCCGTCTGGTGCAACC GGTTCCCCAGGTAGCTCTACTCCTTCTG | 450 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| | TGSP | | GTGCTACTGGCTCCCAGGTGCATCCC CTGGCACCAGCTCTACCGGTTCTCCA | |
| LCW0404_018_GFP-N_D08.ab1 | GTPGSGTASSSPGSSP SASTGTGPGSSTPSGA TGSP | 451 | GGTACTCCTGGTAGCGGTACCGCATCT TCCTCTCCAGGTTCTAGCCCTTCTGCAT CTACCGGTACCGGTCCAGGTAGCTCTA CTCCTTCTGGTGCTACTGGCTCTCCA | 452 |
| LCW0404_023_GFP-N_F08.ab1 | GASPGTSSTGSPGSSP SASTGTGPGTPGSGT ASSSP | 453 | GGTGCTTCCCCGGGCACTAGCTCTACC GGTTCTCCAGGTTCTAGCCCTTCTGCAT CTACTGGTACTGGCCCAGGTACTCCGG GCAGCGGTACTGCTTCTTCCTCTCCA | 454 |
| LCW0404_025_GFP-N_G08.ab1 | GSSTPSGATGSPGSST PSGATGSPGASPGTSS TGSP | 455 | GGTAGCTCTACTCCGTCTGGTGCTACC GGCTCTCCAGGTAGCTCTACCCCTTCT GGTGCAACCGGCTCCCCAGGTGCTTCT CCGGGTACCAGCTCTACTGGTTCTCCA | 456 |
| LCW0404_029_GFP-N_A09.ab1 | GTPGSGTASSSPGSST PSGATGSPGSSPSAST GTGP | 457 | GGTACCCCTGGCAGCGGTACCGCTTCT TCCTCTCCAGGTAGCTCTACCCCGTCTG GTGCTACTGGCTCTCCAGGTTCTAGCC CGTCTGCATCTACCGGTACCGGCCCA | 458 |
| LCW0404_030_GFP-N_B09.ab1 | GSSTPSGATGSPGTPG SGTASSSPGTPGSGTA SSSP | 459 | GGTAGCTCTACTCCTTCTGGTGCAACC GGCTCCCCAGGTACCCCGGGCAGCGGT ACCGCATCTTCCTCTCCAGGTACTCCG GGTAGCGGTACTGCTTCTTCTTCTCCA | 460 |
| LCW0404_031_GFP-N_C09.ab1 | GTPGSGTASSSPGSST PSGATGSPGASPGTSS TGSP | 461 | GGTACCCCGGGTAGCGGTACTGCTTCT TCCTCTCCAGGTAGCTCTACCCCTTCTG GTGCAACCGGCTCTCCAGGTGCTTCTC CGGGCACCAGCTCTACCGGTTCTCCA | 462 |
| LCW0404_034_GFP-N_D09.ab1 | GSSTPSGATGSPGSST PSGATGSPGASPGTSS TGSP | 463 | GGTAGCTCTACCCCGTCTGGTGCTACC GGCTCTCCAGGTAGCTCTACCCCGTCT GGTGCAACCGGCTCCCCAGGTGCATCC CCGGGTACTAGCTCTACCGGTTCTCCA | 464 |
| LCW0404_035_GFP-N_E09.ab1 | GASPGTSSTGSPGTPG SGTASSSPGSSTPSGA TGSP | 465 | GGTGCTTCTCCGGGCACCAGCTCTACT GGTTCTCCAGGTACCCCGGGCAGCGGT ACCGCATCTTCTTCTCCAGGTAGCTCTA CTCCTTCTGGTGCAACTGGTTCTCCA | 466 |
| LCW0404_036_GFP-N_F09.ab1 | GSSPSASTGTGPGSST PSGATGSPGTPGSGT ASSSP | 467 | GGTTCTAGCCCGTCTGCTTCCACCGGT ACTGGCCCAGGTAGCTCTACCCCGTCT GGTGCAACTGGTTCCCCAGGTACCCCT GGTAGCGGTACCGCTTCTTCTTCTCCA | 468 |
| LCW0404_037_GFP-N_G09.ab1 | GASPGTSSTGSPGSSP SASTGTGPGSSTPSGA TGSP | 469 | GGTGCTTCTCCGGGCACCAGCTCTACT GGTTCTCCAGGTTCTAGCCCTTCTGCAT CCACCGGTACCGGTCCAGGTAGCTCTA CCCCTTCTGGTGCAACCGGCTCTCCA | 470 |
| LCW0404_040_GFP-N_H09.ab1 | GASPGTSSTGSPGSST PSGATGSPGSSTPSGA TGSP | 471 | GGTGCATCCCCGGGCACCAGCTCTACC GGTTCTCCAGGTAGCTCTACCCCGTCT GGTGCTACCGGCTCTCCAGGTAGCTCT ACCCCGTCTGGTGCTACTGGCTCTCCA | 472 |
| LCW0404_041_GFP-N_A10.ab1 | GTPGSGTASSSPGSST PSGATGSPGTPGSGT ASSSP | 473 | GGTACCCCTGGTAGCGGTACTGCTTCT TCCTCTCCAGGTAGCTCTACTCCGTCTG GTGCTACCGGTTCTCCAGGTACCCCGG GTAGCGGTACCGCATCTTCTTCTCCA | 474 |
| LCW0404_043_GFP-N_C10.ab1 | GSSPSASTGTGPGSST PSGATGSPGSSTPSGA TGSP | 475 | GGTTCTAGCCCTTCTGCTTCCACCGGTA CTGGCCCAGGTAGCTCTACCCCTTCTG GTGCTACCGGCTCCCCAGGTAGCTCTA CTCCTTCTGGTGCAACTGGCTCTCCA | 476 |
| LCW0404_045_GFP-N_D10.ab1 | GASPGTSSTGSPGSSP SASTGTGPGSSPSAST GTGP | 477 | GGTGCTTCTCCTGGCACCAGCTCTACT GGTTCTCCAGGTTCTAGCCCTTCTGCTT CTACCGGTACTGGTCCAGGTTCTAGCC CTTCTGCATCCACTGGTACTGGTCCA | 478 |
| LCW0404_047_GFP-N_F10.ab1 | GTPGSGTASSSPGASP GTSSTGSPGASPGTSS | 479 | GGTACTCCTGGCAGCGGTACCGCTTCT TCTTCTCCAGGTGCTTCTCCTGGTACTA | 480 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| | TGSP | | GCTCTACTGGTTCTCCAGGTGCTTCTCC GGGCACTAGCTCTACTGGTTCTCCA | |
| LCW0404_048_GFP-N_G10.ab1 | GSSTPSGATGSPGASP GTSSTGSPGSSTPSGA TGSP | 481 | GGTAGCTCTACCCCGTCTGGTGCTACC GGTTCCCCAGGTGCTTCTCCTGGTACT AGCTCTACCGGTTCTCCAGGTAGCTCT ACCCCGTCTGGTGCTACTGGCTCTCCA | 482 |
| LCW0404_049_GFP-N_H10.ab1 | GSSTPSGATGSPGTPG SGTASSSPGSSTPSGA TGSP | 483 | GGTAGCTCTACCCCGTCTGGTGCTACT GGTTCTCCAGGTACTCCGGGCAGCGGT ACTGCTTCTTCCTCTCCAGGTAGCTCTA CCCCTTCTGGTGCTACTGGCTCTCCA | 484 |
| LCW0404_050_GFP-N_A11.ab1 | GASPGTSSTGSPGSSP SASTGTGPGSSTPSGA TGSP | 485 | GGTGCATCTCCTGGTACCAGCTCTACT GGTTCTCCAGGTTCTAGCCCTTCTGCTT CTACCGGTACCGGTCCAGGTAGCTCTA CTCCTTCTGGTGCTACCGGTTCTCCA | 486 |
| LCW0404_051_GFP-N_B11.ab1 | GSSTPSGATGSPGSST PSGATGSPGSSTPSGA TGSP | 487 | GGTAGCTCTACCCCGTCTGGTGCTACT GGCTCTCCAGGTAGCTCTACTCCTTCTG GTGCTACTGGTTCCCAGGTAGCTCTA CCCCGTCTGGTGCAACTGGCTCTCCA | 488 |
| LCW0404_052_GFP-N_C11.ab1 | GASPGTSSTGSPGTPG SGTASSSPGASPGTSS TGSP | 489 | GGTGCATCCCCGGGTACCAGCTCTACC GGTTCTCCAGGTACTCCTGGCAGCGGT ACTGCATCTTCCTCTCCAGGTGCTTCTC CGGGCACCAGCTCTACTGGTTCTCCA | 490 |
| LCW0404_053_GFP-N_D11.ab1 | GSSTPSGATGSPGSSP SASTGTGPGASPGTSS TGSP | 491 | GGTAGCTCTACTCCTTCTGGTGCAACT GGTTCTCCAGGTTCTAGCCCGTCTGCA TCCACTGGTACCGGTCCAGGTGCTTCC CCTGGCACCAGCTCTACCGGTTCTCCA | 492 |
| LCW0404_057_GFP-N_E11.ab1 | GASPGTSSTGSPGSST PSGATGSPGSSPSAST GTGP | 493 | GGTGCATCTCCTGGTACTAGCTCTACT GGTTCTCCAGGTAGCTCTACTCCGTCT GGTGCAACCGGCTCTCCAGGTTCTAGC CCTTCTGCATCTACCGGTACTGGTCCA | 494 |
| LCW0404_060_GFP-N_F11.ab1 | GTPGSGTASSSPGSST PSGATGSPGASPGTSS TGSP | 495 | GGTACTCCTGGCAGCGGTACCGCATCT TCCTCTCCAGGTAGCTCTACTCCGTCTG GTGCAACTGGTTCCCCAGGTGCTTCTC CGGGTACCAGCTCTACCGGTTCTCCA | 496 |
| LCW0404_062_GFP-N_G11.ab1 | GSSTPSGATGSPGTPG SGTASSSPGSSTPSGA TGSP | 497 | GGTAGCTCTACCCCGTCTGGTGCAACC GGCTCCCCAGGTACTCCTGGTAGCGGT ACCGCTTCTTCTTCTCCAGGTAGCTCTA CTCCGTCTGGTGCTACCGGCTCCCCA | 498 |
| LCW0404_066_GFP-N_H11.ab1 | GSSPSASTGTGPGSSP SASTGTGPGASPGTSS TGSP | 499 | GGTTCTAGCCCCTTCTGCATCCACCGGT ACCGGCCCAGGTTCTAGCCCGTCTGCT TCTACCGGTACTGGTCCAGGTGCTTCT CCGGGTACTAGCTCTACTGGTTCTCCA | 500 |
| LCW0404_067_GFP-N_A12.ab1 | GTPGSGTASSSPGSST PSGATGSPGSNPSAST GTGP | 501 | GGTACCCCGGGTAGCGGTACCGCTTCT TCTTCTCCAGGTAGCTCTACTCCGTCTG GTGCTACCGGCTCTCCAGGTTCTAACC CTTCTGCATCCACCGGTACCGGCCCA | 502 |
| LCW0404_068_GFP-N_B12.ab1 | GSSPSASTGTGPGSST PSGATGSPGASPGTSS TGSP | 503 | GGTTCTAGCCCCTTCTGCATCTACTGGTA CTGGCCCAGGTAGCTCTACTCCTTCTG GTGCTACCGGCTCTCCAGGTGCTTCTC CGGGTACTAGCTCTACCGGTTCTCCA | 504 |
| LCW0404_069_GFP-N_C12.ab1 | GSSTPSGATGSPGASP GTSSTGSPGTPGSGTA SSSP | 505 | GGTAGCTCTACCCCTTCTGGTGCAACC GGCTCTCCAGGTGCATCCCCGGGTACC AGCTCTACCGGTTCTCCAGGTACTCCG GGTAGCGGTACCGCTTCTTCCTCTCCA | 506 |
| LCW0404_070_GFP-N_D12.ab1 | GSSTPSGATGSPGSST PSGATGSPGSSTPSGA TGSP | 507 | GGTAGCTCTACTCCGTCTGGTGCAACC GGTTCCCCAGGTAGCTCTACCCCTTCT GGTGCAACCGGCTCTCCAGGTAGCTCT ACCCCTTCTGGTGCAACTGGCTCTCCA | 508 |
| LCW0404_073_GFP-N_E12.ab1 | GASPGTSSTGSPGTPG SGTASSSPGSSTPSGA | 509 | GGTGCTTCTCCTGGCACTAGCTCTACC GGTTCTCCAGGTACCCCTGGTAGCGGT | 510 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| | TGSP | | ACCGCATCTTCCTCTCCAGGTAGCTCT ACTCCTTCTGGTGCTACTGGTTCCCCA | |
| LCW0404_075_GFP-N_F12.ab1 | GSSTPSGATGSPGSSP SASTGTGPGSSPSAST GTGP | 511 | GGTAGCTCTACCCCGTCTGGTGCTACT GGCTCCCCAGGTTCTAGCCCTTCTGCA TCCACCGGTACCGGTCCAGGTTCTAGC CCGTCTGCATCTACTGGTACTGGTCCA | 512 |
| LCW0404_080_GFP-N_G12.ab1 | GASPGTSSTGSPGSSP SASTGTGPGSSPSAST GTGP | 513 | GGTGCTTCCCCGGGCACCAGCTCTACT GGTTCTCCAGGTTCTAGCCCGTCTGCTT CTACTGGTACTGGTCCAGGTTCTAGCC CTTCTGCTTCCACTGGTACTGGTCCA | 514 |
| LCW0404_081_GFP-N_H12.ab1 | GASPGTSSTGSPGSSP SASTGTGPGTPGSGT ASSSP | 515 | GGTGCTTCCCCGGGTACCAGCTCTACC GGTTCTCCAGGTTCTAGCCCTTCTGCTT CTACCGGTACCGGTCCAGGTACCCCTG GCAGCGGTACCGCATCTTCCTCTCCA | 516 |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of E. coli harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs for these segments are listed in Table 12.

TABLE 12

DNA and amino acid sequences for AM144 segments

| Clone | Sequence Trimmed | SEQ ID NO: | Protein Sequence | SEQ ID NO: |
|---|---|---|---|---|
| LCW462_r1 | GGTACCCCGGGCAGCGGTACCGCATCTTC CTCTCCAGGTAGCTCTACCCCGTCTGGTG | 517 | GTPGSGTASSSPGSS TPSGATGSPGSSTPS | 518 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CTACCGGTTCCCCAGGTAGCTCTACCCCG TCTGGTGCAACCGGCTCCCCAGGTAGCCC GGCTGGCTCTCCTACCTCTACTGAGGAAG GTACTTCTGAAAGCGCTACTCCTGAGTCT GGTCCAGGTACCTCTACTGAACCGTCCGA AGGTAGCGCTCCAGGTTCTAGCCCTTCTG CATCCACCGGTACCGGCCCAGGTTCTAGC CCGTCTGCTTCTACCGGTACTGGTCCAGG TGCTTCTCCGGGTACTAGCTCTACTGGTT CTCCAGGTACCTCTACCGAACCGTCCGAG GGTAGCGCACCAGGTACCTCTACTGAACC GTCTGAGGGTAGCGCTCCAGGTAGCGAA CCGGCAACCTCCGGTTCTGAAACTCCA | | GATGSPGSPAGSPTS TEEGTSESATPESGP GTSTEPSEGSAPGSS PSASTGTGPGSSPSA STGTGPGASPGTSST GSPGTSTEPSEGSAP GTSTEPSEGSAPGSE PATSGSETP | |
| LCW462_r5 | GGTTCTACCAGCGAATCCCCTTCTGGCAC TGCACCAGGTTCTACTAGCGAATCCCCTT CTGGTACCGCACCAGGTACTTCTCCGAGC GGCGAATCTTCTACTGCTCCAGGTACCTC TACTGAACCTTCCGAAGGCAGCGCTCCAG GTACCTCTACCGAACCGTCCGAGGGCAGC GCACCAGGTACTTCTGAAAGCGCAACCCC TGAATCCGGTCCAGGTGCATCTCCTGGTA CCAGCTCTACCGGTTCTCCAGGTAGCTCT ACTCCTTCTGGTGCTACTGGCTCTCCAGG TGCTTCCCCGGGTACCAGCTCTACCGGTT CTCCAGGTTCTACTAGCGAATCTCCTTCT GGCACTGCACCAGGTTCTACCAGCGAATC TCCGTCTGGCACTGCACCAGGTACCTCTA CCCCTGAAAGCGGTTCCGCTTCTCCA | 519 | GSTSESPSGTAPGST SESPSGTAPGTSPSG ESSTAPGTSTEPSEG SAPGTSTEPSEGSAP GTSESATPESGPGAS PGTSSTGSPGSSTPS GATGSPGASPGTSST GSPGTSESPSGTAPG GSTSESPSGTAPGTS TPESGSASP | 520 |
| LCW462_r9 | GGTACTTCTACCGAACCTTCCGAGGGCAG CGCACCAGGTACTTCTGAAAGCGCTACCC CTGAGTCCGGCCCAGGTACTTCTGAAAGC GCTACTCCTGAATCCGGTCCAGGTACCTC TACTGAACCTTCTGAGGGCAGCGCTCCAG GTACTTCTGAAAGCGCTACCCCGGAGTCC GGTCCAGGTACTTCTACTGAACCGTCCGA AGGTAGCGCACCAGGTACTTCTACTGAAC CTTCCGAAGGTAGCGCTCCAGGTAGCGA ACCTGCTACTTCTGGTTCTGAAACCCCAG GTAGCCCGGCTGCTCTCCGACCTCCACC GAGGAAGGTGCTTCTCCTGGCACCAGCTC TACTGGTTCTCCAGGTTCTAGCCCTTCTGC TTCTACCGGTACTGGTCCAGGTTCTAGCC CTTCTGCATCCACTGGTACTGGTCCA | 521 | GTSTEPSEGSAPGTS ESATPESGPGTSESA TPESGPGTSTEPSEG SAPGTSESATPESGP GTSTEPSEGSAPGTS TEPSEGSAPGSEPAT SGSETPGSPAGSPTS TEEGASPGTSSTGSP GSSPSASTGTGPGSS PSASTGTGP | 522 |
| LCW462_r10 | GGTAGCGAACCGGCAACCTCTGGCTCTGA AACCCCAGGTACCTCTGAAAGCGCTACTC CGGAATCTGGTCCAGGTACTTCTGAAAGC GCTACTCCGGAATCGGTCCAGGTTCTAC CAGCGAATCTCCTTCTGGCACCGCTCCAG GTTCTACTAGCGAATCCCCGTCTGGTACC GCACCAGGTACTTCTCCTAGCGGCGAATC TTCTACCGCACCAGGTGCATCTCCGGGTA CTAGCTCTACCGGTTCTCCAGGTTCTAGC CCTTCTGCTTCCACTGGTACCGGCCCAGG TAGCTCTACCCCGTCTGGTGCTACTGGTT CCCCAGGTAGCTCTACTCCGTCTGGTGCA ACCGGTTCCCCAGGTAGCTCTACTCCTTC TGGTGCTACTGGCTCCCAGGTGCATCCC CTGGCACCAGCTCTACCGGTTCTCCA | 523 | GSEPATSGSETPGTS ESATPESGPGTSESA TPESGPGTSESPSGT APGSTSESPSGTAPG TSPSGESSTAPGASP GTSSTGSPGSSPSAS TGTGPGSSTPSGATG SPGSSTPSGATGSPG SSTPSGATGSPGASP GTSSTGSP | 524 |
| LCW462_r15 | GGTGCTTCTCCGGGCACCAGCTCTACTGG TTCTCCAGGTTCTAGCCCTTCTGCATCCAC CGGTACCGGTCCAGGTAGCTCTACCCCTT CTGGTGCAACCGGCTCTCCAGGTACTTCT GAAAGCGCTACCCCGGAATCTGGCCCAG GTAGCGAACCGGCTACTTCTGGTTCTGAA ACCCCAGGTAGCGAACCGGCTACCTCCG GTTCTGAAACTCCAGGTACTTCTGAAAGC GCTACTCCGGAGTCCGGTCCAGGTACCTC TACCGAACCGTCCGAAGGCAGCGCTCCA GGTACTTCTACTGAACCTTCTGAGGGTAG CGCTCCAGGTACCTCTACCGAACCGTCCG AGGGTAGCGCACCAGGTACCTCTACTGA | 525 | GASPGTSSTGSPGSS PSASTGTGPGSSTPS GATGSPGTSESATPE SGPGSEPATSGSETP GSEPATSGSETPGTS ESATPESGPGTSTEP SEGSAPGTSTEPSEG SAPGTSTEPSEGSAP GTSTEPSEGSAPGSE PATSGSETP | 526 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | ACCGTCTGAGGGTAGCGCTCCAGGTAGC GAACCGGCAACCTCCGGTTCTGAAACTCCA | | | |
| LCW462_r16 | GGTACCTCTACCGAACCTTCCGAAGGTAG CGCTCCAGGTAGCCCGGCAGGTTCTCCTA CTTCCACTGAGGAAGGTACTTCTACCGAA CCTTCTGAGGGTAGCGCACCAGGTACCTC TGAAAGCGCAACTCCTGAGTCTGGCCCAG GTAGCGAACCTGCTACCTCCGGCTCTGAG ACTCCAGGTACCTCTGAAAGCGCAACCCC GGAATCTGGTCCAGGTAGCCCGGCTGGCT CTCCTACCTCTACTGAGGAAGGTACTTCT GAAAGCGCTACTCCTGAGTCTGGTCCAGG TACCTCTACTGAACCGTCCGAAGGTAGCG CTCCAGGTAGCGAACCTGCTACTTCTGGT TCTGAAACTCCAGGTACTTCTACCGAACC GTCCGAGGGTAGCGCTCCAGGTAGCGAA CCTGCTACTTCTGGTTCTGAAACTCCA | 527 | GTSTEPSEGSAPGSP AGSPTSTEEGTSTEP SEGSAPGTSESATPE SGPGSEPATSGSETP GTSESATPESGPGSP AGSPTSTEEGTSESA TPESGPGTSTEPSEG SAPGSEPATSGSETP GTSTEPSEGSAPGSE PATSGSETP | 528 |
| LCW462_r20 | GGTACTTCTACCGAACCGTCCGAAGGCAG CGCTCCAGGTACCTCTACTGAACCTTCCG AGGGCAGCGCTCCAGGTACCTCTACCGA ACCTTCTGAAGGTAGCGCACCAGGTACTT CTACCGAACCGTCCGAAGGCAGCGCTCC AGGTACCTCTACTGAACCTTCCGAGGGCA GCGCTCCAGGTACCTCTACCGAACCTTCT GAAGGTAGCGCACCAGGTACTTCTACCG AACCTTCCGAGGGCAGCGCACCAGGTAC TTCTGAAAGCGCTACCCCTGAGTCCGGCC CAGGTACTTCTGAAAGCGCTACTCCTGAA TCCGGTCCAGGTACTTCTACTGAACCTTC CGAAGGTAGCGCTCCAGGTAGCGAACCT GCTACTTCTGGTTCTGAAACCCCAGGTAG CCCGGCTGGCTCTCCGACCTCCACCGAGG AA | 529 | GTSTEPSEGSAPGTS TEPSEGSAPGTSTEP SEGSAPGTSTEPSEG SAPGTSTEPSEGSAP GTSTEPSEGSAPGTS TEPSEGSAPGTSESA TPESGPGTSESATPE SGPGSTSTEPSEGSAP GSEPATSGSETPGSP AGSPTSTEE | 530 |
| LCW462_r23 | GGTACTTCTACCGAACCGTCCGAGGGCAG CGCTCCAGGTACTTCTACTGAACCTTCTG AAGGCAGCGCTCCAGGTACTTCTACTGAA CCTTCCGAAGGTAGCGCACCAGGTTCTAC CAGCGAATCCCCTTCTGGTACTGCTCCAG GTTCTACCAGCGAATCCCCTTCTGGCACC GCACCAGGTACTTCTACCCCTGAAAGCGG CTCCGCTTCTCCAGGTAGCGAACCTGCAA CCTCTGGCTCTGAAACCCCAGGTACCTCT GAAAGCGCTACTCCTGAATCTGGCCCAGG TACTTCTACTGAACCGTCCGAGGGCAGCG CACCAGGTACTTCTACTGAACCGTCTGAA GGTAGCGCACCAGGTACTTCTGAAAGCG CAACCCCGGAATCCGGCCCAGGTACCTCT GAAAGCGCAACCCCGGAGTCCGGCCCA | 531 | GTSTEPSEGSAPGTS TEPSEGSAPGTSTEP SEGSAPGSTSESPSG TAPGSTSESPSGTAP GTSTPESGSASPGSE PATSGSETPGTSESA TPESGPGTSTEPSEG SAPGTSTEPSEGSAP GTSESATPESGPGTS ESATPESGP | 532 |
| LCW462_r24 | GGTAGCTCTACCCCTTCTGGTGCTACCGG CTCTCCAGGTTCTAGCCCGTCTGCTTCTAC CGGTACCGGTCCAGGTAGCTCTACCCCTT CTGGTGCTACTGGTTCTCCAGGTAGCCCT GCTGGCTCTCCGACTTCTACTGAGGAAGG TAGCCCGGCTGGTTCTCCGACTTCTACTG AGGAAGGTACTTCTACCGAACCTTCCGAA GGTAGCGCTCCAGGTGCTTCCCCGGGCAC TAGCTCTACCGGTTCTCCAGGTTCTAGCC CTTCTGCATCTACTGGTACTGGCCCAGGT ACTCCGGGCAGCGGTACTGCTTCTTCCTC TCCAGGTTCTACTAGCTCTACTGCTGAAT CTCCTGGCCCAGGTACTTCTCCTAGCGGT GAATCTTCTACCGCTCCAGGTACCTCTAC TCCGGAAAGCGGTTCTGCATCTCCA | 533 | GSSTPSGATGSPGSS PSASTGTGPGSSTPS GATGSPGSPAGSPTS TEEGSPAGSPTSTEE GTSTEPSEGSAPGAS PGTSSTGSPGSSPSAS TGTGPGTPGSGTASS SPGSTSSTAESPGPG TSPSGESSTAPGTSTP ESGSASP | 534 |
| LCW462_r27 | GGTACCTCTACTGAACCTTCTGAGGGCAG CGCTCCAGGTACTTCTGAAAGCGCTACCC CGGAGTCCGGTCCAGGTACTTCTACTGAA CCGTCCGAAGGTAGCGCACCAGGTACTTC TACTGAACCGTCTGAAGGTAGCGCACCA GGTACTTCTGAAAGCGCAACCCCGGAATC CGGCCCAGGTACCTCTGAAAGCGCAACC | 535 | GTSTEPSEGSAPGTS ESATPESGPGTSTEP SEGSAPGTSTEPSEG SAPGTSESATPESGP GTSESATPESGPGTP GSGTASSSPGASPGT SSTGSPGASPGTSST | 536 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CCGGAGTCCGGCCCAGGTACTCCTGGCAG CGGTACCGCTTCTTCTTCTCCAGGTGCTTC TCCTGGTACTAGCTCTACTGGTTCTCCAG GTGCTTCTCCGGGCACTAGCTCTACTGGT TCTCCAGGTAGCCCTGCTGGCTCTCCGAC TTCTACTGAGGAAGGTAGCCCGGCTGGTT CTCCGACTTCTACTGAGGAAGGTACTTCT ACCGAACCTTCCGAAGGTAGCGCTCCA | | GSPGSPAGSPTSTEE GSPAGSPTSTEEGTS TEPSEGSAP | |
| LCW462_r28 | GGTAGCCCAGCAGGCTCTCCGACTTCCAC TGAGGAAGGTACTTCTACTGAACCTTCCG AAGGCAGCGCACCAGGTACCTCTACTGA ACCTTCTGAGGGCAGCGCTCCAGGTACCT CTACCGAACCGTCTGAAGGTAGCGCACC AGGTACCTCTGAAAGCGCAACTCCTGAGT CCGGTCCAGGTACTTCTGAAAGCGCAACC CCGGAGTCTGGCCCAGGTACCCCGGGTA GCGGTACTGCTTCTTCCTCTCCAGGTAGC TCTACCCCTTCTGGTGCAACCGGCTCTCC AGGTGCTTCTCCGGGCACCAGCTCTACCG GTTCTCCAGGTACCTCTACTGAACCTTCT GAGGGCAGCGCTCCAGGTACTTCTGAAA GCGCTACCCCGGAGTCCGGTCCAGGTACT TCTACTGAACCGTCCGAAGGTAGCGCACCA | 537 | GSPAGSPTSTEEGTS TEPSEGSAPGTSTEP SEGSAPGTSTEPSEG SAPGTSESATPESGP GTSESATPESGPGTP GSGTASSSPGSSTPS GATGSPGASPGTSST GSPGTSTEPSEGSAP GTSESATPESGPGTS TEPSEGSAP | 538 |
| LCW462_r38 | GGTAGCGAACCGGCAACCTCCGGCTCTG AAACTCCAGGTACTTCTGAAAGCGCTACT CCGGAATCCGGCCCAGGTAGCGAACCGG CTACTTCCGGCTCTGAAACCCCAGGTAGC TCTACCCCGTCTGGTGCAACCGGCTCCCC AGGTACTCCTGGTAGCGGTACCGCTTCTT CTTCTCCAGGTAGCTCTACTCCGTCTGGT GCTACCGGCTCCCCAGGTGCATCTCCTGG TACCAGCTCTACCGGTTCTCCAGGTAGCT CTACTCCTTCTGGTGCTACTGGCTCTCCA GGTGCTTCCCCGGGTACCAGCTCTACCGG TTCTCCAGGTAGCGAACCTGCTACTTCTG GTTCTGAAACTCCAGGTACTTCTACCGAA CCGTCCGAGGGTAGCGCTCCAGGTAGCG AACCTGCTACTTCTGGTTCTGAAACTCCA | 539 | GSEPATSGSETPGTS ESATPESGPGSEPAT SGSETPGSSTPSGAT GSPGTPGSGTASSSP GSSTPSGATGSPGAS PGTSSTGSPGSSTPS GATGSPGASPGTSST GSPGSEPATSGSETP GTSTEPSEGSAPGSE PATSGSETP | 540 |
| LCW462_r39 | GGTACCTCTACTGAACCTTCCGAAGGCAG CGCTCCAGGTACCTCTACCGAACCGTCCG AGGGCAGCGCACCAGGTACTTCTGAAAG CGCAACCCCTGAATCCGGTCCAGGTAGCC CTGCTGGCTCTCCGACTTCTACTGAGGAA GGTAGCCCGGCTGGTTCTCCGACTTCTAC TGAGGAAGGTACTTCTACCGAACCTTCCG AAGGTAGCGCTCCAGGTAGCCCCGGCTGG TTCTCCGACTTCCACCGAGGAAGGTACCT CTACTGAACCTTCTGAGGGTAGCGCTCCA GGTACCTCTACTGAACCTTCCGAAGGCAG CGCTCCAGGTGCTTCCCCGGGCACCAGCT CTACTGGTTCTCCAGGTTCTAGCCCGTCT GCTTCTACTGGTACTGGTCCAGGTTCTAG CCCTTCTGCTTCCACTGGTACTGGTCCA | 541 | GTSTEPSEGSAPGTS TEPSEGSAPGTSESA TPESGPGSPAGSPTS TEEGSPAGSPTSTEE GTSTEPSEGSAPGSP AGSPTSTEEGTSTEP SEGSAPGTSTEPSEG SAPGASPGTSSTGSP GSSPSASTGTGPGSS PSASTGTGP | 542 |
| LCW462_r41 | GGTAGCTCTACCCCGTCTGGTGCTACCGG TTCCCCAGGTGCTTCTCCTGGTACTAGCT CTACCGGTTCTCCAGGTAGCTCTACCCCG TCTGGTGCTACTGGCTCTCCAGGTAGCCC TGCTGGCTCTCCAACCTCCACCGAAGAAG GTACCTCTGAAAGCGCAACCCCTGAATCC GGCCCAGGTAGCGAACCGGCAACCTCCG GTTCTGAAACCCCAGGTGCATCTCCTGGT ACTAGCTCTACTGGTTCTCCAGGTAGCTC TACTCCGTCTGGTGCAACCGGCTCTCCAG GTTCTAGCCCTTCTGCATCTACCGGTACT GGTCCAGGTTCTACCAGCGAATCCCCTTC TGGTACTGCTCCAGGTTCTACCAGCGAAT CCCCTTCTGGCACCGCACCAGGTACTTCT ACCCCTGAAAGCGGCTCCGCTTCTCCA | 543 | GSSTPSGATGSPGAS PGTSSTGSPGSSTPS GATGSPGSPAGSPTS TEEGTSESATPESGP GSEPATSGSETPGAS PGTSSTGSPGSSTPS GATGSPGSSPSASTG TGPGSTSESPSGTAP GSTSESPSGTAPGTS TPESGSASP | 544 |
| LCW462_r42 | GGTTCTACCAGCGAATCTCCTTCTGGCAC CGCTCCAGGTTCTACTAGCGAATCCCCGT | 545 | GSTSESPSGTAPGST SESPSGTAPGTSPSG | 546 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CTGGTACCGCACCAGGTACTTCTCCTAGC<br>GGCGAATCTTCTACCGCACCAGGTACCTC<br>TGAAAGCGCTACTCCGGAGTCTGGCCCAG<br>GTACCTCTACTGAACCGTCTGAGGGTAGC<br>GCTCCAGGTACTTCTACTGAACCGTCCGA<br>AGGTAGCGCACCAGGTACCTCTACTGAAC<br>CTTCTGAGGGCAGCGCTCCAGGTACTTCT<br>GAAAGCGCTACCCCGGAGTCCGGTCCAG<br>GTACTTCTACTGAACCGTCCGAAGGTAGC<br>GCACCAGGTAGCTCTACCCCGTCTGGTGC<br>TACCGGTTCCCCAGGTGCTTCTCCTGGTA<br>CTAGCTCTACCGGTTCTCCAGGTAGCTCT<br>ACCCCGTCTGGTGCTACTGGCTCTCCA | | ESSTAPGTSESATPE<br>SGPGTSTEPSEGSAP<br>GTSTEPSEGSAPGTS<br>TEPSEGSAPGTSESA<br>TPESGPGTSTEPSEG<br>SAPGSSTPSGATGSP<br>GASPGTSSTGSPGSS<br>TPSGATGSP | |
| LCW462_r43 | GGTTCTACTAGCTCTACTGCAGAATCTCC<br>GGGCCCAGGTACCTCTCCTAGCGGTGAAT<br>CTTCTACCGCTCCAGGTACTTCTCCGAGC<br>GGTGAATCTTCTACCGCTCCAGGTTCTAC<br>TAGCTCTACCGCTGAATCTCCGGGTCCAG<br>GTTCTACCAGCTCTACTGCAGAATCTCCT<br>GGCCCAGGTACTTCTACTCCGGAAAGCGG<br>TTCCGCTTCTCCAGGTACTTCTCCTAGCG<br>GTGAATCTTCTACCGCTCCAGGTTCTACC<br>AGCTCTACTGCTGAATCTCCTGGCCCAGG<br>TACTTCTACCCCGGAAAGCGGCTCCGCTT<br>CTCCAGGTTCTACCAGCTCTACCGCTGAA<br>TCTCCTGGCCCAGGTTCTACTAGCGAATC<br>TCCGTCTGGCACCGCACCAGGTACTTCCC<br>CTAGCGGTGAATCTTCTACTGCACCA | 547 | GSTSSTAESPGPGTS<br>PSGESSTAPGTSPSG<br>ESSTAPGSTSSTAESP<br>GPGSTSSTAESPGPG<br>TSTPESGSASPGTSPS<br>GESSTAPGSTSSTAE<br>SPGPGTSTPESGSAS<br>PGSTSSTAESPGPGS<br>TSESPSGTAPGTSPS<br>GESSTAP | 548 |
| LCW462_r45 | GGTACCTCTACTCCGGAAAGCGGTTCCGC<br>ATCTCCAGGTTCTACCAGCGAATCCCCGT<br>CTGGCACCGCACCAGGTTCTACTAGCTCT<br>ACTGCTGAATCTCCGGGCCCAGGTACCTC<br>TACTGAACCTTCCGAAGGCAGCGCTCCAG<br>GTACCTCTACCGAACCGTCCGAGGGCAGC<br>GCACCAGGTACTTCTGAAAGCGCAACCCC<br>TGAATCCGGTCCAGGTACCTCTGAAAGCG<br>CTACTCCGGAGTCTGGCCCAGGTACCTCT<br>ACTGAACCGTCTGAGGGTAGCGCTCCAG<br>GTACTTCTACTGAACCGTCCGAAGGTAGC<br>GCACCAGGTACTTCTGAAAGCGCTACTCC<br>GGAGTCCGGTCCAGGTACCTCTACCGAAC<br>CGTCCGAAGGCAGCGCTCCAGGTACTTCT<br>ACTGAACCTTCTGAGGGTAGCGCTCCC | 549 | GTSTPESGSASPGST<br>SESPSGTAPGSTSST<br>AESPGPGTSTEPSEG<br>SAPGTSTEPSEGSAP<br>GTSESATPESGPGTS<br>ESATPESGPGTSTEP<br>SEGSAPGTSTEPSEG<br>SAPGTSESATPESGP<br>GTSTEPSEGSAPGTS<br>TEPSEGSAP | 550 |
| LCW462_r47 | GGTACCTCTACCGAACCGTCCGAGGGTAG<br>CGCACCAGGTACCTCTACTGAACCGTCTG<br>AGGGTAGCGCTCCAGGTAGCGAACCGGC<br>AACCTCCGGTTCTGAAACTCCAGGTACTT<br>CTACTGAACCGTCTGAAGGTAGCGCACCA<br>GGTACTTCTGAAAGCGCAACCCCGGAATC<br>CGGCCCAGGTACCTCTGAAAGCGCAACC<br>CCGGAGTCCGGCCCAGGTGCATCTCCGGG<br>TACTAGCTCTACCGGTTCTCCAGGTTCTA<br>GCCCTTCTGCTTCCACTGGTACCGGCCCA<br>GGTAGCTCTACCCCGTCTGGTGCTACTGG<br>TTCCCCAGGTAGCTCTACTCCGTCTGGTG<br>CAACCGGTTCCCCAGGTAGCTCTACTCCT<br>TCTGGTGCTACTGGCTCCCCAGGTGCATC<br>CCCTGGCACCAGCTCTACCGGTTCTCCA | 551 | GTSTEPSEGSAPGTS<br>TEPSEGSAPGSEPAT<br>SGSETPGTSTEPSEG<br>SAPGTSESATPESGP<br>GTSESATPESGPGAS<br>PGTSSTGSPGSSPSAS<br>TGTGPGSSTPSGATG<br>SPGSSTPSGATGSPG<br>SSTPSGATGSPGASP<br>GTSSTGSP | 552 |
| LCW462_r54 | GGTAGCGAACCGGCAACCTCTGGCTCTGA<br>AACTCCAGGTAGCGAACCTGCAACCTCCG<br>GCTCTGAAACCCCAGGTACTTCTACTGAA<br>CCTTCTGAGGGCAGCGCACCAGGTAGCG<br>AACCTGCAACCTCTGGCTCTGAAACCCCA<br>GGTACCTCTGAAAGCGCTACTCCTGAATC<br>TGGCCCAGGTACTTCTACTGAACCGTCCG<br>AGGGCAGCGCACCAGGTAGCTCTACTCC<br>GTCTGGTGCTACCGGCTCTCCAGGTAGCT<br>CTACCCCTTCTGGTGCAACCGGCTCCCCA<br>GGTGCTTCTCCGGGTACCAGCTCTACTGG<br>TTCTCCAGGTAGCTCTACCCCGTCTGGTG<br>CTACCGGTTCCCCAGGTGCTTCTCCTGGT | 553 | GSEPATSGSETPGSE<br>PATSGSETPGTSTEP<br>SEGSAPGSEPATSGS<br>ETPGTSESATPESGP<br>GTSTEPSEGSAPGSS<br>TPSGATGSPGSSTPS<br>GATGSPGASPGTSST<br>GSPGSSTPSGATGSP<br>GASPGTSSTGSPGSS<br>TPSGATGSP | 554 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | ACTAGCTCTACCGGTTCTCCAGGTAGCTC TACCCCGTCTGGTGCTACTGGCTCTCCA | | | |
| LCW462_r55 | GGTACTTCTACCGAACCGTCCGAGGGCAG CGCTCCAGGTACTTCTACTGAACCTTCTG AAGGCAGCGCTCCAGGTACTTCTACTGAA CCTTCCGAAGGTAGCGCACCAGGTACTTC TGAAAGCGCTACTCCGGAGTCCGGTCCAG GTACCTCTACCGAACCGTCCGAAGGCAGC GCTCCAGGTACTTCTACTGAACCTTCTGA GGGTAGCGCTCCAGGTTCTACTAGCGAAT CTCCGTCTGGCACTGCTCCAGGTACTTCT CCTAGCGGTGAATCTTCTACCGCTCCAGG TACTTCCCCTAGCGGCGAATCTTCTACCG CTCCAGGTAGCCCGGCTGGCTCTCCTACC TCTACTGAGGAAGGTACTTCTGAAAGCGC TACTCCTGAGTCTGGTCCAGGTACCTCTA CTGAACCGTCCGAAGGTAGCGCTCCA | 555 | GTSTEPSEGSAPGTS TEPSEGSAPGTSTEP SEGSAPGTSESATPE SGPGTSTEPSEGSAP GTSTEPSEGSAPGST SESPSGTAPGTSPSG ESSTAPGTSPSGESST APGSPAGSPTSTEEG TSESATPESGPGTST EPSEGSAP | 556 |
| LCW462_r57 | GGTACTTCTACTGAACCTTCCGAAGGTAG CGCTCCAGGTAGCGAACCTGCTACTTCTG GTTCTGAAACCCCAGGTAGCCCGGCTGGC TCTCCGACCTCCACCGAGGAAGGTAGCCC GGCAGGCTCTCCGACCTCTACTGAGGAAG GTACTTCTGAAAGCGCAACCCCGGAGTCC GGCCCAGGTACCTCTACCGAACCGTCTGA GGGCAGCGCACCAGGTACCTCTACTGAA CCTTCCGAAGGCAGCGCTCCAGGTACCTC TACCGAACCGTCCGAGGGCAGCGCACCA GGTACTTCTGAAAGCGCAACCCCTGAATC CGGTCCAGGTAGCTCTACTCCGTCTGGTG CAACCGGCTCCCCAGGTTCTAGCCCGTCT GCTTCCACTGGTACTGGCCCAGGTGCTTC CCCGGGCACCAGCTCTACTGGTTCTCCA | 557 | GTSTEPSEGSAPGSE PATSGSETPGSPAGS PTSTEEGSPAGSPTS TEEGTSESATPESGP GTSTEPSEGSAPGTS TEPSEGSAPGTSTEP SEGSAPGTSESATPE SGPGSSTPSGATGSP GSSPSASTGTGPGAS PGTSSTGSP | 558 |
| LCW462_r61 | GGTAGCGAACCGGCTACTTCCGGCTCTGA GACTCCAGGTAGCCCTGCTGGCTCTCCGA CCTCTACCGAAGAAGGTACCTCTGAAAGC GCTACCCCTGAGTCTGGCCCAGGTACCTC TACTGAACCTTCCGAAGGCAGCGCTCCAG GTACCTCTACCGAACCGTCCGAGGGCAGC GCACCAGGTACTTCTGAAAGCGCAACCCC TGAATCCGGTCCAGGTACCTCTACTCCGG AAAGCGGTTCCGCATCTCCAGGTTCTACC AGCGAATCCCCGTCTGGCACCGCACCAG GTTCTACTAGCTCTACTGCTGAATCTCCG GGCCCAGGTACTTCTGAAAGCGCTACTCC GGAGTCCGGTCCAGGTACCTCTACCGAAC CGTCCGAAGGCAGCGCTCCAGGTACTTCT ACTGAACCTTCTGAGGGTAGCGCTCCA | 559 | GSEPATSGSETPGSP AGSPTSTEEGTSESA TPESGPGTSTEPSEG SAPGTSTEPSEGSAP GTSESATPESGPGTS TPESGSASPGSTSESP SGTAPGSTSSTAESP GPGTSESATPESGPG TSTEPSEGSAPGTST EPSEGSAP | 560 |
| LCW462_r64 | GGTACTTCTACCGAACCGTCCGAGGGCAG CGCTCCAGGTACTTCTACTGAACCTTCTG AAGGCAGCGCTCCAGGTACTTCTACTGAA CCTTCCGAAGGTAGCGCACCAGGTACCTC TACCGAACCGTCTGAAGGTAGCGCACCA GGTACCTCTGAAAGCGCAACTCCTGAGTC CGGTCCAGGTACTTCTGAAAGCGCAACCC CGGAGTCTGGCCCAGGTACTCCTGGCAGC GGTACCGCATCTTCCTCTCCAGGTAGCTC TACCCGTCTGGTGCAACTGGTTCCCCAG GTGCTTCTCCGGGTACCAGCTCTACCGGT TCTCCAGGTTCCACCAGCTCTACTGCTGA ATCCTGGTCCAGGTACCTCTCCTAGCG GTGAATCTTCTACTGCTCCAGGTACTTCT ACTCCTGAAAGCGGCTCTGCTTCTCCA | 561 | GTSTEPSEGSAPGTS TEPSEGSAPGTSTEP SEGSAPGTSESATPE SGPGTSESATPESGP GTSESATPESGPGTP GSGTASSSPGSSTPS GATGSPGASPGTSST GSPGSTSSTAESPGP GTSPSGESSTAPGTS TPESGSASP | 562 |
| LCW462_r67 | GGTAGCCCGGCAGGCTCTCCGACCTCTAC TGAGGAAGGTACTTCTGAAAGCGCAACC CCGGAGTCCGGCCCAGGTACCTCTACCGA ACCGTCTGAGGGCAGCGCACCAGGTACTT CTGAAAGCGCAACCCCTGAATCCGGTCCA GGTAGCGAACCGGCTACTTCTGGCTCTGA GACTCCAGGTACTTCTACCGAACCGTCCG AAGGTAGCGCACCAGGTAGCCCGGCTGG | 563 | GSPAGSPTSTEEGTS ESATPESGPGTSTEP SEGSAPGTSESATPE SGPGSEPATSGSETP GTSTEPSEGSAPGSP AGSPTSTEEGTSTEP SEGSAPGTSTEPSEG SAPGTSTEPSEGSAP | 564 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | TTCTCCGACTTCCACCGAGGAAGGTACCT CTACTGAACCTTCTGAGGGTAGCGCTCCA GGTACCTCTACTGAACCTTCCGAAGGCAG CGCTCCAGGTACTTCTACCGAACCGTCCG AGGGCAGCGCTCCAGGTACTTCTACTGAA CCTTCTGAAGGCAGCGCTCCAGGTACTTC TACTGAACCTTCCGAAGGTAGCGCACCA | | GTSTEPSEGSAPGTS TEPSEGSAP | |
| LCW462_r69 | GGTACTTCTCCGAGCGGTGAATCTTCTAC CGCACCAGGTTCTACTAGCTCTACCGCTG AATCTCCGGGCCCAGGTACTTCTCCGAGC GGTGAATCTTCTACTGCTCCAGGTACCTC TGAAAGCGCTACTCCGGAGTCTGGCCCAG GTACCTCTACTGAACCGTCTGAGGGTAGC GCTCCAGGTACTTCTACTGAACCGTCCGA AGGTAGCGCACCAGGTTCTAGCCCTTCTG CATCTACTGGTACTGGCCCAGGTAGCTCT ACTCCTTCTGGTGCTACCGGCTCTCCAGG TGCTTCTCCGGGTACTAGCTCTACCGGTT CTCCAGGTACTTCTACTCCGGAAAGCGGT TCCGCATCTCCAGGTACTTCTCCTAGCGG TGAATCTTCTACTGCTCCAGGTACCTCTC CTAGCGGCGAATCTTCTACTGCTCCA | 565 | GTSPSGESSTAPGST SSTAESPGPGTSPSG ESSTAPGTSESATPE SGPGTSTEPSEGSAP GTSTEPSEGSAPGSS PSASTGTGPGSSTPS GATGSPGASPGTSST GSPGTSTPESGSASP GTSPSGESSTAPGTS PSGESSTAP | 566 |
| LCW462_r70 | GGTACCTCTGAAAGCGCTACTCCGGAGTC TGGCCCAGGTACCTCTACTGAACCGTCTG AGGGTAGCGCTCCAGGTACTTCTACTGAA CCGTCCGAAGGTAGCGCACCAGGTAGCC CTGCTGGCTCTCCGACTTCTACTGAGGAA GGTAGCCCGGCTGGTTCTCCGACTTCTAC TGAGGAAGGTACTTCTACCGAACCTTCCG AAGGTAGCGCTCCAGGTTCTAGCCCTTCT GCTTCCACCGGTACTGGCCCAGGTAGCTC TACCCCTTCTGGTGCTACCGGCTCCCCAG GTAGCTCTACTCCTTCTGGTGCAACTGGC TCTCCAGGTAGCGAACCGGCAACTTCCGG TCTGAAACCCCAGGTACTTCTGAAAGCG CTACTCCTGAGTCTGGCCCAGGTAGCGAA CCTGCTACCTCTGGCTCTGAAACCCCA | 567 | GTSESATPESGPGTS TEPSEGSAPGTSTEP SEGSAPGSPAGSPTS TEEGSPAGSPTSTEE GTSTEPSEGSAPGSS PSASTGTGPGSSTPS GATGSPGSSTPSGAT GSPGSEPATSGSETP GTSESATPESGPGSE PATSGSETP | 568 |
| LCW462_r72 | GGTACTTCTACCGAACCGTCCGAAGGCAG CGCTCCAGGTACCTCTACTGAACCTTCCG AGGGCAGCGCTCCAGGTACCTCTACCGA ACCTTCTGAAGGTAGCGCACCAGGTAGCT CTACCCCCGTCTGGTGCTACCGGTTCCCCA GGTGCTTCTCCTGGTACTAGCTCTACCGG TTCTCCAGGTAGCTCTACCCCGTCTGGTG CTACTGGCTCTCCAGGTACTTCTGAAAGC GCAACCCCTGAATCCGGTCCAGGTAGCG AACCGGCTACTTCTGGCTCTGAGACTCCA GGTACTTCTACCGAACCGTCCGAAGGTAG CGCACCAGGTTCTACTAGCGAATCTCCTT CTGGCACTGCACCAGGTTCTACCAGCGAA TCTCCGTCTGGCACTGCACCAGGTACCTC TACCCCTGAAAGCGGTTCCGCTTCTCCA | 569 | GTSTEPSEGSAPGTS TEPSEGSAPGTSTEP SEGSAPGSSTPSGAT GSPGASPGTSSTGSP GSSTPSGATGSPGTS ESATPESGPGSEPAT SGSETPGTSTEPSEG SAPGSTSESPSGTAP GSTSESPSGTAPGTS TPESGSASP | 570 |
| LCW462_r73 | GGTACCTCTACTCCTGAAAGCGGTTCTGC ATCTCCAGGTTCCACTAGCTCTACCGCAG AATCTCCGGGCCCAGGTTCTACTAGCTCT ACTGCTGAATCTCCTGGCCCAGGTTCTAG CCCTTCTGCATCTACTGGTACTGGCCCAG GTAGCTCTACTCCTTCTGGTGCTACCGGC TCTCCAGGTGCTTCTCCGGGTACTAGCTC TACCGGTTCTCCAGGTAGCGAACCGGCAA CCTCCGGCTCTGAAACCCCAGGTACCTCT GAAAGCGCTACTCCTGAATCCGGCCCAG GTAGCCCGGCAGGTTCTCCGACTTCCACT GAGGAAGGTTCTACTAGCGAATCTCCTTC TGGCACTGCACCAGGTTCTACCAGCGAAT CTCCGTCTGGCACTGCACCAGGTACCTCT ACCCCTGAAAGCGGTTCCGCTTCTCCC | 571 | GTSTPESGSASPGST SSTAESPGPGTSSST AESPGPGSSPSASTG TGPGSSTPSGATGSP GASPGTSSTGSPGSE PATSGSETPGTSESA TPESGPGSPAGSPTS TEEGSTSESPSGTAP GSTSESPSGTAPGTS TPESGSASP | 572 |
| LCW462_r78 | GGTAGCCCGGCTGGCTCTCCTACCTCTAC TGAGGAAGGTACTTCTGAAAGCGCTACTC CTGAGTCTGGTCCAGGTACCTCTACTGAA | 573 | GSPAGSPTSTEEGTS ESATPESGPGTSTEP SEGSAPGSTSESPSG | 574 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CCGTCCGAAGGTAGCGCTCCAGGTTCTAC CAGCGAATCTCCTTCTGGCACCGCTCCAG GTTCTACTAGCGAATCCCCGTCTGGTACC GCACCAGGTACTTCTCCTAGCGGCGAATC TTCTACCGCACCAGGTACCTCTACCGAAC CTTCCGAAGGTAGCGCTCCAGGTAGCCCG GCAGGTTCTCCTACTTCCACTGAGGAAGG TACTTCTACCGAACCTTCTGAGGGTAGCG CACCAGGTAGCGAACCTGCAACCTCTGGC TCTGAAACCCCAGGTACCTCTGAAAGCGC TACTCCTGAATCTGGCCCAGGTACTTCTA CTGAACCGTCCGAGGGCAGCGCACCA | | TAPGSTSESPSGTAP GTSPSGESSTAPGTS TEPSEGSAPGSPAGS PTSTEEGTSTEPSEGS APGSEPATSGSETPG TSESATPESGPGTST EPSEGSAP | |
| LCW462_r79 | GGTACCTCTACCGAACCTTCCGAAGGTAG CGCTCCAGGTAGCCCGGCAGGTTCTCCTA CTTCCACTGAGGAAGGTACTTCTACCGAA CCTTCTGAGGGTAGCGCACCAGGTACCTC CCCTAGCGGCGAATCTTCTACTGCTCCAG GTACCTCTCCTAGCGGCGAATCTTCTACC GCTCCAGGTACCTCCCCTAGCGGTGAATC TTCTACCGCACCAGGTTCTACCAGCGAAT CCCCTTCTGGTACTGCTCCAGGTTCTACC AGCGAATCCCCTTCTGGCACCGCACCAGG TACTTCTACCCCTGAAAGCGGCTCCGCTT CTCCAGGTAGCGAACCTGCAACCTCTGGC TCTGAAACCCCAGGTACCTCTGAAAGCGC TACTCCTGAATCTGGCCCAGGTACTTCTA CTGAACCGTCCGAGGGCAGCGCACCA | 575 | GTSTEPSEGSAPGSP AGSPTSTEEGTSTEP SEGSAPGTSPSGESS TAPGTSPSGESSTAP GTSPSGESSTAPGST SESPSGTAPGSTSESP SGTAPGTSTPESGSA SPGSEPATSGSETPG TSESATPESGPGTST EPSEGSAP | 576 |
| LCW462_r87 | GGTAGCGAACCGGCAACCTCTGGCTCTGA AACCCCAGGTACCTCTGAAAGCGCTACTC CGGAATCTGGTCCAGGTACTTCTGAAAGC GCTACTCCGGAATCCGGTCCAGGTACTTC TCCGAGCGGTGAATCTTCTACCGCACCAG GTTCTACTAGCTCTACCGCTGAATCTCCG GGCCCAGGTACTTCTCCGAGCGGTGAATC TTCTACTGCTCCAGGTTCTACTAGCGAAT CCCCGTCTGGTACTGCTCCAGGTACTTCC CCTAGCGGTGAATCTTCTACTGCTCCAGG TTCTACCAGCTCTACCGCAGAATCTCCGG GTCCAGGTAGCTCTACTCCGTCTGGTGCA ACCGGTTCCCCAGGTAGCTCTACCCCTTC TGGTGCAACCGGCTCCCAGGTAGCTCTA CCCCTTCTGGTGCAAACTGGCTCTCC | 577 | GSEPATSGSETPGTS ESATPESGPGTSESA TPESGPGTSPSGESST APGSTSSTAESPGPG TSPSGESSTAPGSTSE SPSGTAPGTSPSGES STAPGSTSSTAESPG PGSSTPSGATGSPGS STPSGATGSPGSSTP SGANWLS | 578 |
| LCW462_r88 | GGTAGCCCTGCTGGCTCTCCGACTTCTAC TGAGGAAGGTAGCCCGGCTGGTTCTCCGA CTTCTACTGAGGAAGGTACTTCTACCGAA CCTTCCGAAGGTAGCGCTCCAGGTACCTC TACTGAACCTTCCGAAGGCAGCGCTCCAG GTACCTCTACCGAACCGTCCGAGGGCAGC GCACCAGGTACTTCTGAAAGCGCAACCCC TGAATCCGGTCCAGGTGCATCTCCTGGTA CCAGCTCTACCGGTTCTCCAGGTAGCTCT ACTCCTTCTGGTGCTACTGGCTCTCCAGG TGCTTCCCCGGGTACCAGCTCTACCGGTT CTCCAGGTAGCTCTACCCCGTCTGGTGCT ACTGGTTCTCCAGGTACTCCGGGCAGCGG TACTGCTTCTTCCTCTCCAGGTAGCTCTAC CCCTTCTGGTGCTACTGGCTCTCCA | 579 | GSPAGSPTSTEEGSP AGSPTSTEEGTSTEP SEGSAPGTSTEPSEG SAPGTSTEPSEGSAP GTSESATPESGPGAS PGTSSTGSPGSSTPS GATGSPGASPGTSST GSPGSSTPSGATGSP GTPGSGTASSSPGSS TPSGATGSP | 580 |
| LCW462_r89 | GGTAGCTCTACCCCGTCTGGTGCTACTGG TTCTCCAGGTACTCCGGGCAGCGGTACTG CTTCTTCCTCTCCAGGTAGCTCTACCCCTT CTGGTGCTACTGGCTCTCCAGGTAGCCCG GCTGGCTCTCCTACCTCTACTGAGGAAGG TACTTCTGAAAGCGCTACTCCTGAGTCTG GTCCAGGTACCTCTACTGAACCGTCCGAA GGTAGCGCTCCAGGTACCTCTGAAAGCGC AACTCCTGAGTCTGGCCCAGGTAGCGAAC CTGCTACCTCCGGCTCTGAGACTCCAGGT ACCTCTGAAAGCGCAACCCCGGAATCTG GTCCAGGTACTTCTACTGAACCGTCTGAA GGTAGCGCACCAGGTACTTCTGAAAGCG | 581 | GSSTPSGATGSPGTP GSGTASSSPGSSTPS GATGSPGSPAGSPTS TEEGTSESATPESGP GTSTEPSEGSAPGTS ESATPESGPGSEPAT SGSETPGTSESATPE SGPGTSTEPSEGSAP GTSESATPESGPGTS ESATPESGP | 582 |

TABLE 12-continued

DNA and amino acid sequences for AM144 segments

| Clone | Sequence Trimmed | SEQ ID NO: | Protein Sequence | SEQ ID NO: |
|---|---|---|---|---|
| | CAACCCCGGAATCCGGCCCAGGTACCTCT GAAAGCGCAACCCCGGAGTCCGGCCCA | | | |

Example 7
Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8
Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of *E. coli* harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening of this library yielded 4 isolates that were selected for further construction

Example 9
Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 583) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 584) for introducing the sequencing island A (SI-A) which encodes amino acids GASASGAPSTG (SEQ ID NO: 585) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in Example 5. This new library of XTEN_AM875 segment was designated LCW0481.

Example 10
Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 586) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 587) for introducing the sequencing island B (SI-B) which encodes amino acids GPEPTGPAPSG (SEQ ID NO: 588) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in Example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in Example 5. This new library of XTEN_AM1318 segment was designated LCW0487.

Example 11
Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12
Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full-length clone of XTEN_AG864 had excellent solubility and showed half-life exceeding 60 h in cynomolgus monkeys.

Example 14

Construction of N-Terminal Extensions of XTEN-Construction and Screening of 12 mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain). To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of seven libraries. The resulting clones have N-terminal XTEN 12 mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 13).

TABLE 13

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---|---|---|---|---|---|
| LCW546 | AE12 | MASPAGSPTSTEE | 589 | 572 | 2 plates (168) |
| LCW547 | AE12 | MATSESATPESGP | 590 | 1536 | 5 plates (420) |
| LCW548 | AF12 | MATSPSGESSTAP | 591 | 192 | 2 plates (168) |
| LCW549 | AF12 | MESTSSTAESPGP | 592 | 384 | 2 plates (168) |
| LCW552 | AG12 | MASSTPSGATGSP | 593 | 384 | 2 plates (168) |
| LCW553 | AG12 | MEASPGTSSTGSP | 594 | 384 | 2 plates (168) |
| LCW554 | (CBD-like) | MASTPESGSSG | 595 | 32 | 1 plate (84) |

Figure 9:
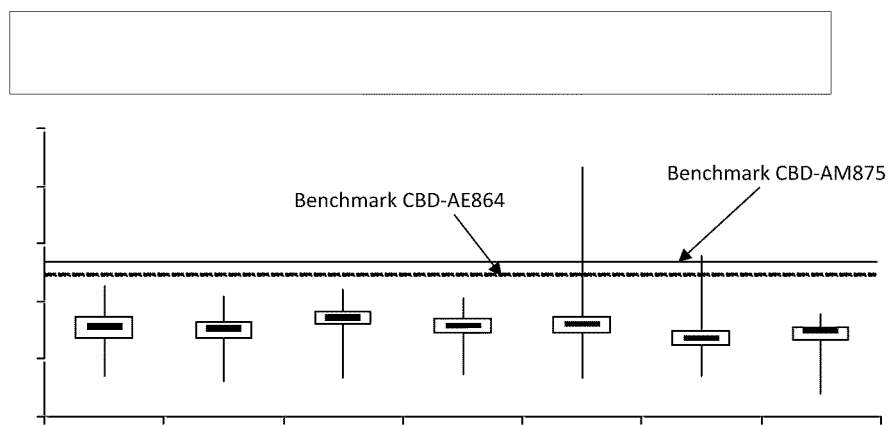
FIG. 9 shows results of expression assays for the indicated constructs comprising GFP and XTEN sequences. The expression cultures were assayed using a fluorescence plate reader (excitation 395 nm, emission 510 nm) to determine the amount of GFP reporter present. The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. The results also show that the libraries starting with amino acids MA had better expression levels than those beginning with ME (see Example 14).

The saturated overnight cultures were used to inoculate fresh 500 µl cultures in auto-induction media in which they were grown overnight at 26° C. These expression cultures were then assayed using a fluorescence plate reader (excitation 395 nm, emission 510 nm) to determine the amount of GFP reporter present (see FIG. 9 for results of expression assays). The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, where as only 75% of the sequences in the libraries beginning with MA, a clear over representation of the clones beginning with MA at the highest level of expression. 96 of the best clones were sequenced to confirm identity and twelve sequences (see Table 14), 4 from LCW546, 4 from LCW547 and 4 from LCW552 were selected for further optimization.

TABLE 14

Advanced 12mer DNA Nucleotide Sequences

| Clone | DNA Nucleotide Sequence | SEQ ID NO: |
|---|---|---|
| LCW546_02 | ATGGCTAGTCCGGCTGGCTCTCCGACCTCCACTGAGGAAGGTACTTCTACT | 596 |
| LCW546_06 | ATGGCTAGTCCTGCTGGCTCTCCAACCTCCACTGAGGAAGGTACTTCTACT | 597 |
| LCW546_07 | ATGGCTAGTCCAGCAGGCTCTCCTACCTCCACCGAGGAAGGTACTTCTACT | 598 |
| LCW546_09 | ATGGCTAGTCCTGCTGGCTCTCCGACCTCTACTGAGGAAGGTACTTCTACT | 599 |
| LCW547_03 | ATGGCTACATCCGAAAGCGCAACCCCTGAGTCCGGTCCAGGTACTTCTACT | 600 |
| LCW547_06 | ATGGCTACATCCGAAAGCGCAACCCCTGAATCTGGTCCAGGTACTTCTACT | 601 |
| LCW547_10 | ATGGCTACGTCTGAAAGCGCTACTCCGGAATCTGGTCCAGGTACTTCTACT | 602 |
| LCW547_17 | ATGGCTACGTCCGAAAGCGCTACCCCTGAATCCGGTCCAGGTACTTCTACT | 603 |
| LCW552_03 | ATGGCTAGTTCTACCCCGTCTGGTGCAACCGGTTCCCCAGGTACTTCTACT | 604 |
| LCW552_05 | ATGGCTAGCTCCACTCCGTCTGGTGCTACCGGTTCCCCAGGTACTTCTACT | 605 |
| LCW552_10 | ATGGCTAGCTCTACTCCGTCTGGTGCTACTGGTTCCCCAGGTACTTCTACT | 606 |
| LCW552_11 | ATGGCTAGTTCTACCCCTTCTGGTGCTACTGGTTCTCCAGGTACTTCTACT | 607 |

Example 15

Construction of N-Terminal Extensions of XTEN-Construction and Screening of Libraries Optimizing Codons 3 and 4

Figure 11:
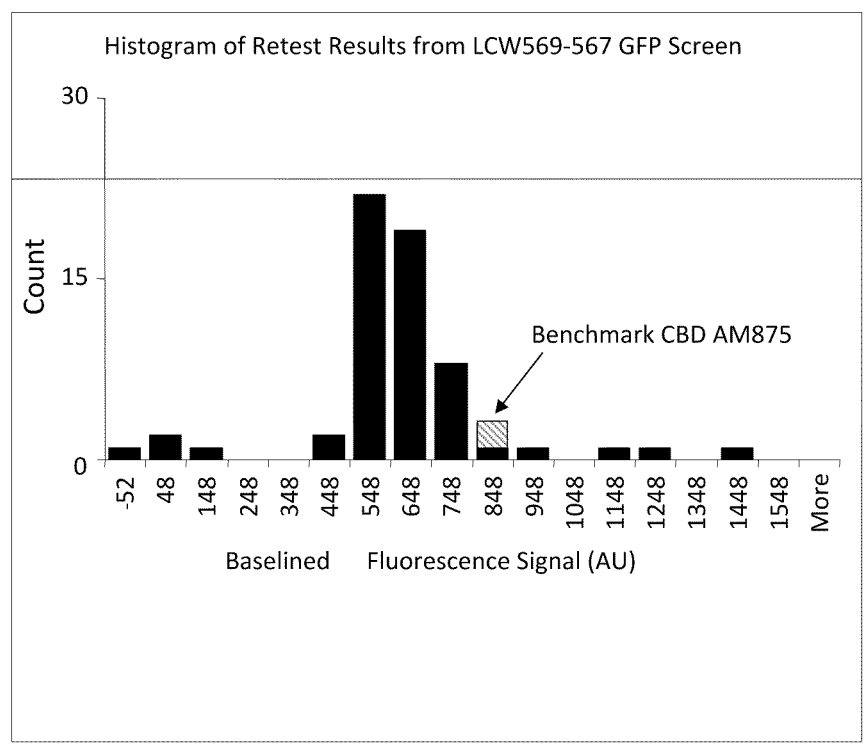
FIG. 11 shows a histogram of a retest of the top 75 clones after the optimization step, as described in Example 15, for GFP fluorescence signal, relative to the benchmark CBD_AM875 construct. The results indicated that several clones were now superior to the benchmark clones.

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 10). In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of three libraries LCW0569-571. With 24×TEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 11). 52 clones yielded usable sequencing data and were used for subsequent analysis. The results were broken down by library and indicate that LCW546 was the superior library. The results are presented in Table 15. Surprisingly, it was discovered that base-lined fluorescence readings for the best clones were ~900 AU, whereas the CBD N-terminal benchmark was only ~600 AU. This indicates that this library had instituted an approximately 33% improvement over the best clones from the previous library which were approximately equal in expression to the CBD N-terminal benchmark (Example 14).

TABLE 15

Third and Fourth Codon Optimization Library Comparison

| | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 16.

TABLE 16

Preferred Third and Fourth Codons in LCW569

| | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Figure 12:
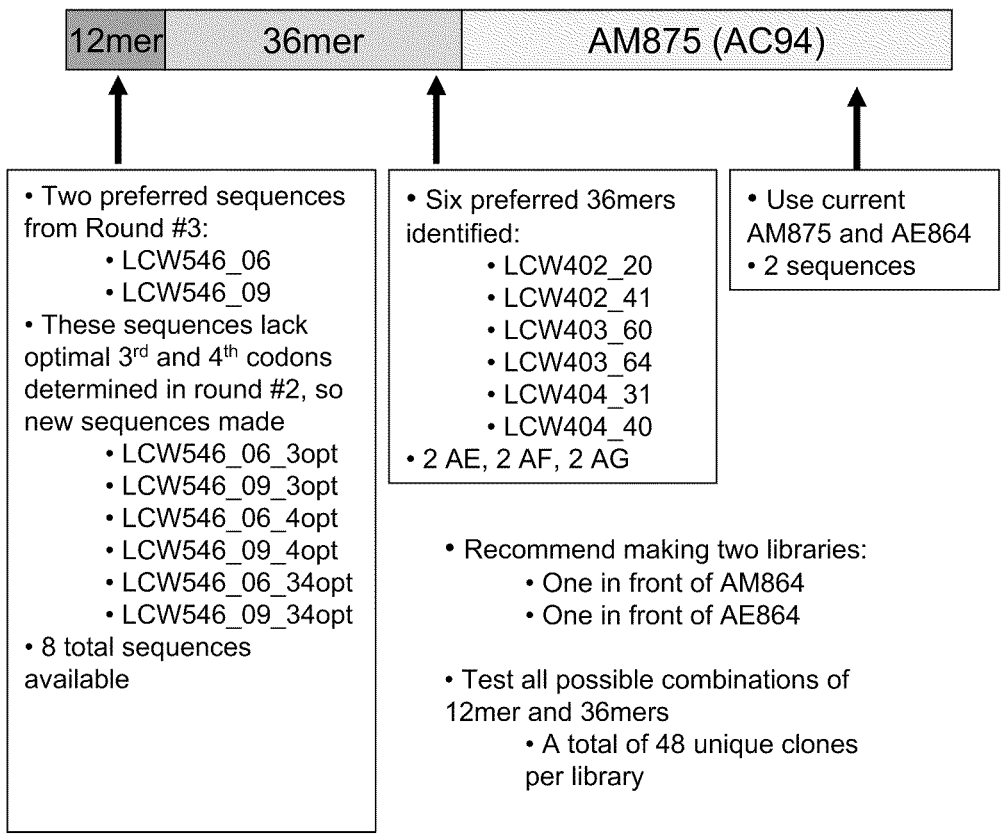
FIG. 12 is a schematic of a combinatorial approach undertaken for the union of codon optimization preferences for two regions of the N-terminus 48 amino acids. The approach created novel 48 mers at the N-terminus of the XTEN protein for evaluation of the optimization of expression that resulted in leader sequences that may be a solution for expression of XTEN proteins where the XTEN is N-terminal to the GH.

Construction of N-Terminal Extensions of XTEN-Construction and Screening of Combinatorial 12 mer and 36 mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12 mer sequences (see Example supra) at the very N-terminus followed by 125 previously constructed 36 mer segments (see example supra) in a combinatorial manner. This created novel 48 mers at the N-terminus of the XTEN protein and enabled the assessment of the impact of longer-range interactions at the N-terminus on expression of the longer sequences (FIG. 12). Similar to the dimerization procedures used to assemble 36 mers (see Example infra), the plasmids containing the 125 selected 36 mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12 mers at the very N-terminus. The plasmids of LCW0579 were digested with NdeI/EcoRI/BsaI and the appropriate fragments were gel-purified. 12 pairs of oligonucleotides encoding 12 selected 12 mer sequences were designed, annealed and ligated with the NdeI/EcoRI/BsaI digested LCW0579 vector, and transformed into E. coli BL21Gold(DE3) competent cells to obtain colonies of the library LCW0580. With a theoretical diversity of 1500 unique clones, a total of 1512 individual colonies from the created library were picked and grown overnight to saturation in 500 µl of super broth media in a 96 deep well plate. This provided sufficient coverage to understand relative library performance and sequence preferences.

The saturated overnight cultures were used to inoculate new 500 µl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12 mer that was present in each clone and the impact of each 12 mer on expression was assessed. Clones LCW546_06 and LCW546_09 stood out as being the superior N-terminus (see Table 17).

TABLE 17

Relative Performance of Clones Starting with LCW546 06 and LCW459 09

|  | LCW546_06 | All Others | LCW546_09 | All Others |
| --- | --- | --- | --- | --- |
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 18. It was noted that these were the only occurrences of these sequences and in no case did one of these sequences occur and fail to beat the bench-mark clone. These six sequences were advanced for further optimization.

TABLE 18

Combinatorial 12mer and 36mer Clones Superior to Benchmark Clone

| Clone Name | First 60 codons | SEQ ID NO: | 12mer Name | 36mer Name |
| --- | --- | --- | --- | --- |
| LCW580_51 | ATGGCTAGTCCTGCTGGCTCTCCAACCTCCACT GAGGAAGGTGCATCCCCGGGCACCAGCTCTACC GGTTCTCCAGGTAGCTCTACCCCGTCTGGTGCT ACCGGCTCTCCAGGTAGCTCTACCCCGTCTGGT GCTACTGGCTCTCCAGGTACTTCTACTGAACCG TCTGAAGGCAGCGCA | 608 | LCW546_06 | LCW0404_040 |
| LCW580_81 | ATGGCTAGTCCTGCTGGCTCTCCAACCTCCACT GAGGAAGGTGCATCCCCGGGCACCAGCTCTACC GGTTCTCCAGGTAGCTCTACCCCGTCTGGTGCT ACCGGCTCTCCAGGTAGCTCTACCCCGTCTGGT GCTACTGGCTCTCCAGGTACTTCTACTGAACCG TCTGAAGGCAGCGCA | 609 | LCW546_06 | LCW0404_040 |
| LCW580_38 | ATGGCTAGTCCTGCTGGCTCTCCAACCTCCACT GAGGAAGGTACTTCTACCGAACCGTCCGAGGGT AGCGCACCAGGTAGCCCAGCAGGTTCTCCTACC TCCACCGAGGAAGGTACTTCTACCGAACCGTCC GAGGGTAGCGCACCAGGTACTTCTACTGAACCG TCTGAAGGCAGCGCA | 610 | LCW546_06 | LCW0402_041 |
| LCW580_63 | ATGGCTAGTCCTGCTGGCTCTCCGACCTCTACT GAGGAAGGTACTTCTACTGAACCGTCTGAAGGC | 611 | LCW546_09 | LCW0402_020 |

TABLE 18-continued

Combinatorial 12mer and 36mer Clones Superior to Benchmark Clone

| Clone Name | First 60 codons | SEQ ID NO: | 12mer Name | 36mer Name |
|---|---|---|---|---|
| | AGCGCACCAGGTAGCGAACCGGCTACTTCCGGT TCTGAAACCCCAGGTAGCCCAGCAGGTTCTCCA ACTTCTACTGAAGAAGGTACTTCTACTGAACCG TCTGAAGGCAGCGCA | | | |
| LCW580_06 | ATGGCTAGTCCTGCTGGCTCTCCAACCTCCACT GAGGAAGGTACCCCGGGTAGCGGTACTGCTTCT TCCTCTCCAGGTAGCTCTACCCCTTCTGGTGCAA CCGGCTCTCCAGGTGCTTCTCCGGGCACCAGCT CTACCGGTTCTCCAGGTACTTCTACTGAACCGT CTGAAGGCAGCGCA | 612 | LCW546_06 | LCW0404_031 |
| LCW580_35 | ATGGCTAGTCCTGCTGGCTCTCCGACCTCTACT GAGGAAGGTACTTCTACTGAACCGTCTGAAGGC AGCGCACCAGGTAGCGAACCGGCTACTTCCGGT TCTGAAACCCCAGGTAGCCCAGCAGGTTCTCCA ACTTCTACTGAAGAAGGTACTTCTACTGAACCG TCTGAAGGCAGCGCA | 613 | LCW546_09 | LCW0402_020 |
| LCW580_67 | ATGGCTAGTCCTGCTGGCTCTCCGACCTCTACT GAGGAAGGTACCTCCCCTAGCGGCGAATCTTCT ACTGCTCCAGGTACCTCTCCTAGCGGCGAATCT TCTACCGCTCCAGGTACCTCCCCTAGCGGTGAA TCTTCTACCGCACCAGGTACTTCTACTGAACCG TCTGAAGGCAGCGCA | 614 | LCW546_09 | LCW0403_064 |
| LCW580_13 | ATGGCTAGTCCTGCTGGCTCTCCGACCTCTACT GAGGAAGGTACCTCTACTCCGGAAAGCGGTTCC GCATCTCCAGGTTCTACCAGCGAATCCCCGTCT GGCACCGCACCAGGTTCTACTAGCTCTACTGCT GAATCTCCGGGCCCAGGTACTTCTACTGAACCG TCTGAAGGCAGCGCA | 615 | LCW546_09 | LCW0403_060 |
| LCW580_88 | ATGGCTAGTCCTGCTGGCTCTCCGACCTCTACT GAGGAAGGTACCTCCCCTAGCGGCGAATCTTCT ACTGCTCCAGGTACCTCTCCTAGCGGCGAATCT TCTACCGCTCCAGGTACCTCCCCTAGCGGTGAA TCTTCTACCGCACCAGGTACTTCTACTGAACCG TCTGAAGGCAGCGCA | 616 | LCW546_09 | LCW0403_064 |
| LCW580_11 | ATGGCTAGTCCTGCTGGCTCTCCGACCTCTACT GAGGAAGGTACCTCTACTCCGGAAAGCGGTTCC GCATCTCCAGGTTCTACCAGCGAATCCCCGTCT GGCACCGCACCAGGTTCTACTAGCTCTACTGCT GAATCTCCGGGCCCAGGTACTTCTACTGAACCG TCTGAAGGCAGCGCA | 617 | LCW546_09 | LCW0403_060 |

Example 17

Construction of N-Terminal Extensions of XTEN-Construction and Screening of Combinatorial 12 mer and 36 mer Libraries for XTEN-AM1875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12 mers and 36 mers (see Example supra) established, a combinatorial approach was undertaken to examine the union of these preferences. This created novel 48 mers at the N-terminus of the XTEN protein and enabled the testing of the confluence of previous conclusions. Additionally, the ability of these leader sequences to be a universal solution for all XTEN proteins was assessed by placing the new 48 mers in front of both XTEN-AE864 and XTEN-AM875. Instead of using all 125 clones of 36 mer segment, the plasmids from 6 selected clones of 36 mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (—XTEN_AM875-GFP) and LCW0586 (—XTEN_AE864-GFP), which could also serve as the vectors for further cloning 8 selected 12 mers at the very N-terminus. The plasmids of LCW0585 and LCW0586 were digested with NdeI/EcoRI/BsaI and the appropriate fragments were gel-purified. 8 pairs of oligonucleotides encoding 8 selected 12 mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12 mer, the third codon, the fourth codon and the 36 mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 19 and 20). These date support the conclusion that the inclusion of the sequences encoding the optimized N-terminal XTEN into the fusion protein genes conferred a marked enhancement on the expression of the fusion proteins.

TABLE 19

Preferred N-terminal Combinations for XTEN-AM875

| Clone Name | Number of Replicates | 12mer | 36mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 20

Preferred N-terminal Combinations for XTEN-AE864

| Clone Name | Number of Replicates | 12mer | 36mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 13:
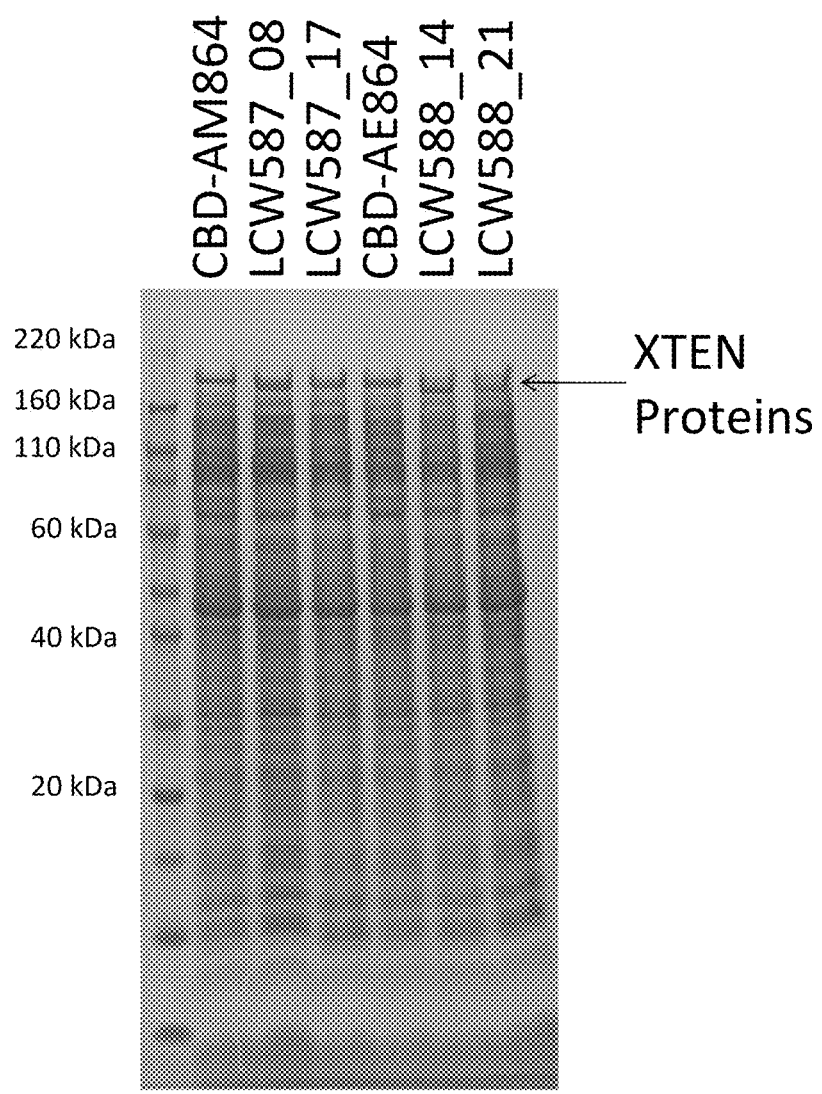
FIG. 13 shows an SDS-PAGE gel confirming expression of preferred clones obtained from the XTEN N-terminal codon optimization experiments, in comparison to benchmark XTEN clones comprising CBD leader sequences at the N-terminus of the construct sequences, as described in Example 17.

Notably, the preferred combination of the N-terminal for the XTEN-AM875 and the preferred combination for the XTEN-AE864 are not the same (Tables 19 and 20), indicating more complex interactions further than 150 bases from the initiation site influence expression levels. The sequences for the preferred nucleotide sequences are listed in Table 21 and the preferred clones were analyzed by SDS-PAGE to independently confirm expression (see FIG. 13). The complete sequences of XTEN_AM923 and XTEN_AE912 were selected for further analysis.

TABLE 21

Preferred DNA Nucleotide Sequences for first 48 Amino Acid Residues of N-terminal XTEN-AM875 and XTEN-AE864

| Clone Name | XTEN Modified | DNA Nucleotide Sequence | SEQ ID NO: |
|---|---|---|---|
| LCW587_08 | AM875 | ATGGCTGAACCTGCTGGCTCTCCAACCTCCACTGAGGAAGGT GCATCCCCGGGCACCAGCTCTACCGGTTCTCCAGGTAGCTCTA CCCCGTCTGGTGCTACCGGCTCTCCAGGTAGCTCTACCCCGTC TGGTGCTACTGGCTCTCCAGGTACTTCTACTGAACCGTCTGAA GGCAGCGCA | 618 |
| LCW587_17 | AM875 | ATGGCTGAACCTGCTGGCTCTCCGACCTCTACTGAGGAAGGT ACCTCCCCTAGCGGCGAATCTTCTACTGCTCCAGGTACCTCTC CTAGCGGCGAATCTTCTACCGCTCCAGGTACCTCCCCTAGCGG TGAATCTTCTACCGCACCAGGTACTTCTACTGAACCGTCTGAA GGCAGCGCA | 619 |
| LCW588_14 | AE864 | ATGGCTGAACCTGCTGGCTCTCCAACCTCCACTGAGGAAGGT ACCCCGGGTAGCGGTACTGCTTCTTCCTCTCCAGGTAGCTCTA CCCCTTCTGGTGCAACCGGCTCTCCAGGTGCTTCTCCGGGCAC | 620 |

TABLE 21-continued

Preferred DNA Nucleotide Sequences for first 48 Amino Acid Residues
of N-terminal XTEN-AM875 and XTEN-AE864

| Clone Name | XTEN Modified | DNA Nucleotide Sequence | SEQ ID NO: |
|---|---|---|---|
| | | CAGCTCTACCGGTTCTCCAGGTAGCCCGGCTGGCTCTCCTACC TCTACTGAG | |
| LCW588_27 | AE864 | ATGGCTGAAACTGCTGGCTCTCCAACCTCCACTGAGGAAGGT GCATCCCCGGGCACCAGCTCTACCGGTTCTCCAGGTAGCTCTA CCCCGTCTGGTGCTACCGGCTCTCCAGGTAGCTCTACCCCGTC TGGTGCTACTGGCTCTCCAGGTAGCCCGGCTGGCTCTCCTACC TCTACTGAG | 621 |

Example 18

Methods of Producing and Evaluating GHXTEN; XTEN-bGH as Example

A general schema for producing and evaluating GHXTEN compositions is presented in FIG. 6, and forms the basis for the general description of this Example. Using the disclosed methods and those known to one of ordinary skill in the art, together with guidance provided in the illustrative examples, a skilled artesian can create and evaluate a range of GHXTEN fusion proteins comprising, XTENs, GH and variants of GH known in the art. The Example is, therefore, to be construed as merely illustrative, and not limitative of the methods in any way whatsoever; numerous variations will be apparent to the ordinarily skilled artisan. In this Example, a GHXTEN of bovine growth hormone linked to an XTEN of the AE family of motifs would be created.

The general scheme for producing polynucleotides encoding XTEN is presented in FIGS. 4 and 5. FIG. 5 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 1. In this case, the motifs of the AE family would be used as the motif library, which are annealed to the 12-mer to create a "building block" length; e.g., a segment that encodes 36 amino acids. The gene encoding the XTEN sequence can be assembled by ligation and multimerization of the "building blocks" until the desired length of the XTEN gene 504 is achieved. As illustrated in FIG. 5, the XTEN length in this case is 48 amino acid residues, but longer lengths can be achieved by this process. For example, multimerization can be performed by ligation, overlap extension, PCR assembly or similar cloning techniques known in the art. The XTEN gene can be cloned into a stuffer vector. In the example illustrated in FIG. 5, the vector can encode a Flag sequence 506 followed by a stuffer sequence that is flanked by BsaI, BbsI, and KpnI sites 507 and a GH gene (e.g., bGH) 508, resulting in the gene encoding the GHXTEN 500, which, in this case encodes the fusion protein in the configuration, N— to C-terminus, XTEN-bGH.

DNA sequences encoding GH can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. A gene or polynucleotide encoding the GH portion of the protein can be then be cloned into a construct, such as those described herein, which can be a plasmid or other vector under control of appropriate transcription and translation sequences for high level protein expression in a biological system. A second gene or polynucleotide coding for the XTEN portion (in the case of FIG. 5 illustrated as an AE with 48 amino acid residues) can be genetically fused to the nucleotides encoding the N-terminus of the bGH gene by cloning it into the construct adjacent and in frame with the gene coding for the bGH, through a ligation or multimerization step. In this manner, a chimeric DNA molecule coding for (or complementary to) the XTEN-bGH GHXTEN fusion protein would be generated within the construct. Optionally, a gene encoding for a second XTEN could be inserted and ligated in-frame to the nucleotides encoding the C-terminus of the XTEN-bGH gene, resulting in a construct encoding an XTEN-bGH-XTEN fusion protein. The construct can be designed in different configurations to encode the various permutations of the fusion partners as a monomeric polypeptide. For example, the gene can be created to encode the fusion protein in the order (N- to C-terminus): bGH-XTEN; XTEN-bGH; bGH-XTEN-bGH; XTEN-bGH-XTEN; as well as multimers of the foregoing. Optionally, this chimeric DNA molecule may be transferred or cloned into another construct that is a more appropriate expression vector. At this point, a host cell capable of expressing the chimeric DNA molecule would be transformed with the chimeric DNA molecule. The vectors containing the DNA segments of interest can be transferred into an appropriate host cell by well-known methods, depending on the type of cellular host, as described supra.

Host cells containing the XTEN-GH expression vector would be cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, cells would be harvested by centrifugation, disrupted by physical or chemical means, and the resulting crude extract retained for purification of the fusion protein, as described below. For GHXTEN compositions secreted by the host cells, supernatant from centrifugation would be separated and retained for further purification.

Gene expression would be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression would be measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the GH sequence polypeptide using a synthetic peptide based on the sequences provided herein or against exogenous sequence fused to GH and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The XTEN-GH polypeptide product would be purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 6, the isolated XTEN-GH fusion proteins would then be characterized for their chemical and activity properties. Isolated fusion protein would be characterized, e.g., for sequence, purity, apparent molecular weight, solubility and stability using standard methods known in the art. The fusion protein meeting expected standards would then be evaluated for activity, which can be measured in vitro or in vivo by measuring one of the growth hormone-associated parameters described herein, using one or more assays disclosed herein, or using the assays of the Examples or Table 34.

In addition, the XTEN-GH fusion protein would be administered to one or more animal species to determine standard pharmacokinetic parameters, as described in Examples 30-32.

By the iterative process of producing, expressing, and recovering XTEN-GH constructs, followed by their characterization using methods disclosed herein or others known in the art, the GHXTEN compositions comprising GH and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused GH. For those fusion proteins not possessing the desired properties, a different sequence can be constructed, expressed, isolated and evaluated by these methods in order to obtain a composition with such properties.

Example 19

Construction of Genes and Vectors of hGH Linked to K and Y XTEN Sequences

K Series GHXTEN Constructs

Figure 20:
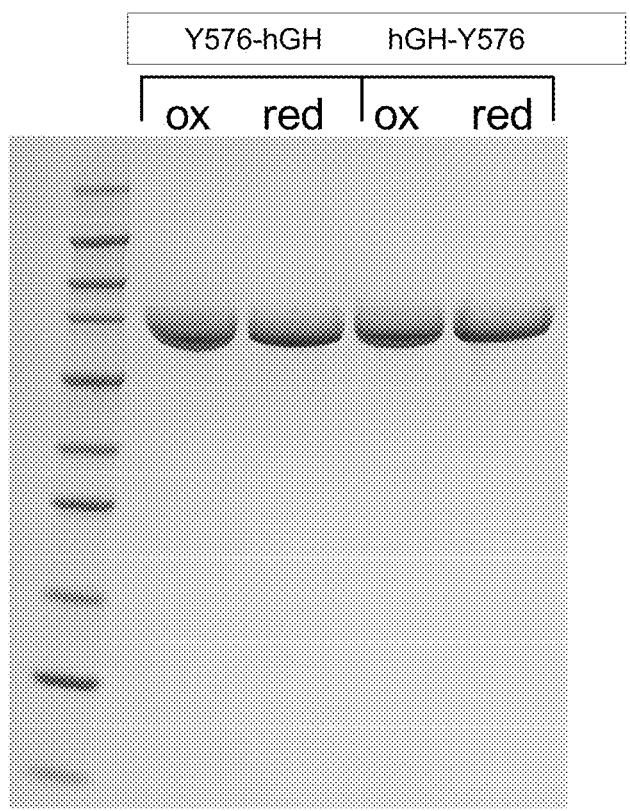
FIG. 20 shows SDS-PAGE analysis of 5 μg of final purified protein of hGH fused to Y576 in the configurations of hGH-Y576 and Y576-hGH animaled to both non-reducing and reducing SDS-PAGE, as described in Example 24, using NuPAGE 4-12% Bis-Tris gel from Invitrogen according to manufacturer's specifications.

A pET-series vector was constructed with T7 promoter, which expresses a protein containing cellulose binding domain (CBD) at the N-terminus, followed by a Tomato Etch Virus (TEV) protease cleavage site, followed by the hGH coding sequence, and by the K288 coding sequence: CBD-K288-hGH. The K288 has the repetitive sequence (GEGGGEGGE)$_{32}$ (SEQ ID NO: 622). The CBD sequence used is shown in Swissprot file Q06851 and the purification of CBD fusion proteins is described in Ofir, K. et al. (2005) Proteomics 5:1806. The sequence of the TEV cleavage site is ENLYFQ/X (SEQ ID NO: 623); G was used in the X position. This construct was transformed into BL21(DE3)-star E. coli strain and grown under conditions promoting expression. Cells were collected and disrupted. The cellular supernatant was applied on beaded cellulose resin (Perloza 100), washed with buffer A (25 mM Tris pH=8.0) and eluted from the column with 20 mM NaOH. pH was adjusted by titrating the sample with 1M Tris buffer pH=8.0. Protein purity was estimated to be above 90%. The eluted protein was digested with purified TEV protease overnight at 4° C., and the digested sample was applied to a beaded cellulose resin (Perloza 100). The CBD was retained on the column, and the K288-hGH was found in the column flow-through. The pooled flow-through was loaded on the anion-exchange (Q-sepharose, Pharmacia), washed with buffer A (25 mM Tris pH=8.0) and eluted from the column using a shallow linear gradient of same buffer with 1M NaCl. The eluted fusion protein was pooled, dialyzed against buffer A, concentrated, and purified by size-exclusion chromatography (SEC) as the final purification. Protein purity was estimated to be above 98%. The final protein is K288-hGH. SDS PAGE analyses of samples throughout the purification process are shown in FIG. 20.

Y Series GHXTEN Constructs

The gene encoding hGH was amplified by polymerase chain reaction (PCR), which introduced BbsI and HindIII restriction sites that are compatible with the BbsI and HindIII sites that flank the stuffer in the XTEN destination vector. The pCBD-XTEN plasmid is a pET30 derivative from Novagen in the format of Cellulose Binding Domain (CBD)-XTEN-Stuffer, where Stuffer is green fluorescent protein (GFP) and XTEN can be any length from 36 to 576 or greater. Constructs were generated by replacing a stuffer sequence in pCBD-XTEN with the hGH-encoding fragment (FIG. 7B). The pCBD-XTEN features a T7 promoter upstream of CBD followed by an XTEN sequence fused in-frame upstream of the stuffer sequence. The XTEN sequences employed belong to family XTEN_Y and encode lengths that include 36, 72, 144, 288, and 576 amino acids. The stuffer fragment was removed by restriction digest using BbsI and HindIII endonucleases. Restriction digested hGH DNA fragment was ligated into the cleaved pCBD-XTEN vector using T4 DNA ligase and electroporated into BL21(DE3) Gold (Stratagene). Transformants were screened by DNA miniprep and the desired construct was confirmed by DNA sequencing. The final vector yields the CBD_XTEN_hGH gene under the control of a T7 promoter. The resulting DNA sequences encoded for GH linked to XTEN of lengths of 36, 72, 144, and 288 amino acids, respectively.

Example 20

Construction of hGH-XTEN Genes and Vectors Using AE and am XTEN Sequences

Figure 7:
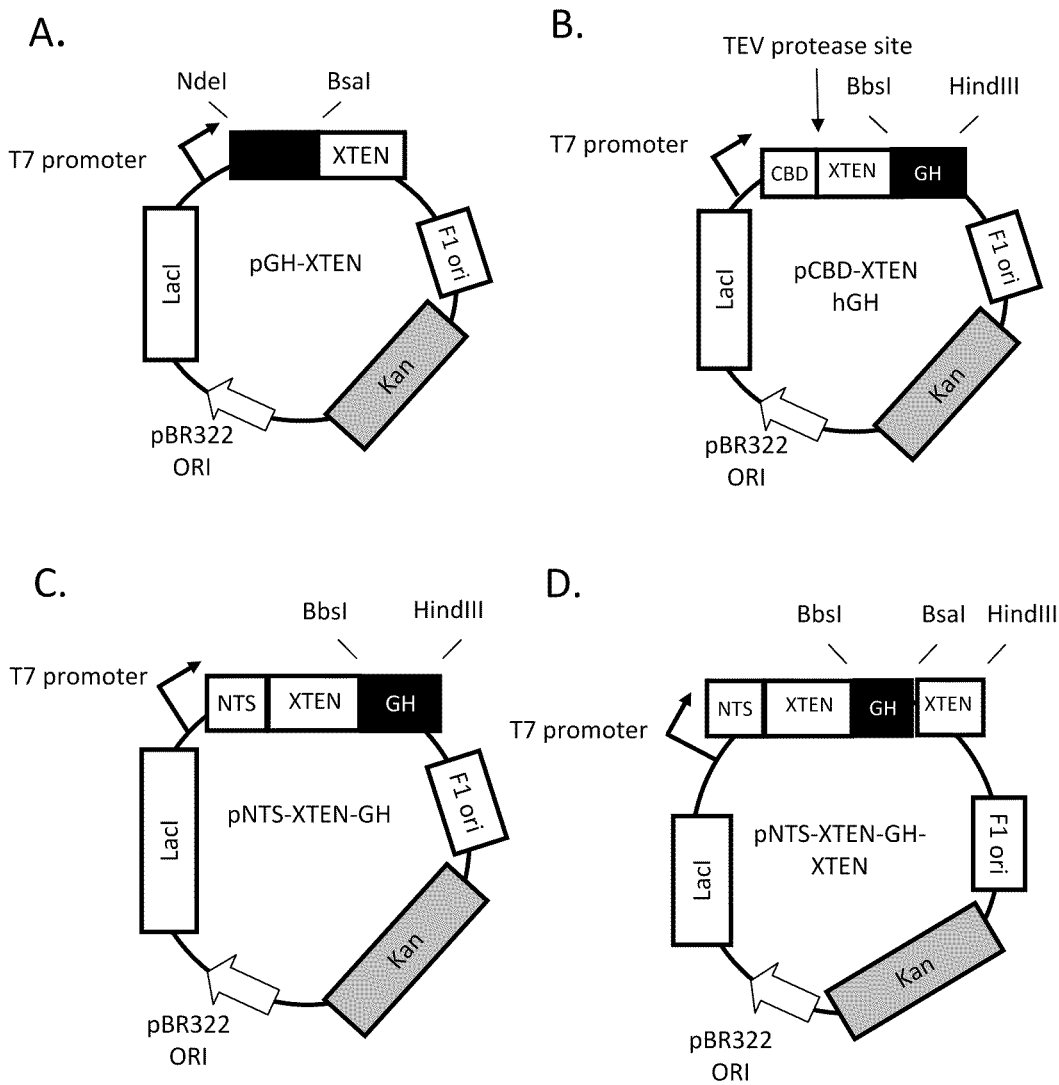
FIGS. 7A-D show schematic representations of the design of GHXTEN expression vectors with different processing strategies.

The gene encoding hGH was amplified by polymerase chain reaction (PCR), which introduced NdeI and BbsI restriction sites that are compatible with the NdeI and BsaI sites that flank the stuffer in the XTEN destination vector. The pXTEN plasmid is a pET30 derivative from Novagen in the format of Stuffer-XTEN, where Stuffer can be either green fluorescent protein (GFP) or CBD and XTEN can be any length from 36 to 1318 amino acids or greater (FIG. 7). Constructs were generated by replacing a stuffer sequence in pXTEN with the hGH-encoding fragment. The pXTEN features a T7 promoter upstream of the stuffer sequence, and an XTEN sequence fused in-frame downstream of the stuffer sequence. The XTEN sequences employed belong to the AE or AM family of XTEN and encode lengths that include 36, 72, 144, 288, 576, 864, 875 and 1318 amino acids. The stuffer fragment was removed by restriction digest using NdeI and BsaI endonucleases. Restriction digested hGH DNA fragment was ligated into the cleaved pXTEN vector using T4 DNA ligase and electroporated into BL21(DE3) Gold (Stratagene). Transformants were screened by DNA miniprep and the desired constructs were confirmed by DNA sequencing. The final vector yields the hGH-XTEN gene under the control of a T7 promoter, and would be used to express a fusion protein with hGH at the N-terminus.

Example 21

Construction of XTEN-hGH and XTEN-hGH Genes and Vectors Using AE and AM XTEN Sequences The gene encoding hGH was amplified by polymerase chain reaction (PCR), which introduced BbsI and HindIII restriction sites that are compatible with the BbsI and HindIII sites that flank the stuffer in the XTEN destination vector. The pCBD-XTEN plasmid is a pET30 derivative from Novagen in the format of Cellulose Binding Domain (CBD)-XTEN-Stuffer, where Stuffer is green fluorescent protein (GFP) and XTEN can be any length from 36 to 1318 or greater (FIG. 7). Constructs were generated by replacing a stuffer sequence in pCBD-XTEN with the hGH-encoding fragment. The pCBD-XTEN features a T7 promoter upstream of CBD followed by an XTEN sequence fused in-frame upstream of the stuffer sequence. The XTEN sequences employed belong to family XTEN_AE and XTEN_AM and encode lengths that include 36, 72, 144, 288, 576, 864, 875 and 1318 amino acids. The stuffer fragment was removed by restriction digest using BbsI and HindIII endonucleases. Restriction digested hGH DNA fragment was ligated into the cleaved pCBD-XTEN vector using T4 DNA ligase and electroporated into BL21(DE3) Gold (Stratagene). Transformants were screened by DNA miniprep and the desired construct was confirmed by DNA sequencing. The final vector yields the CBD_XTEN_hGH gene under the control of a T7 promoter, and would be used to express a fusion protein with hGH at the C-terminus.

Example 22

Construction of XTEN-AE_hGH_XTEN-AE Genes and Vectors

Figure 8:
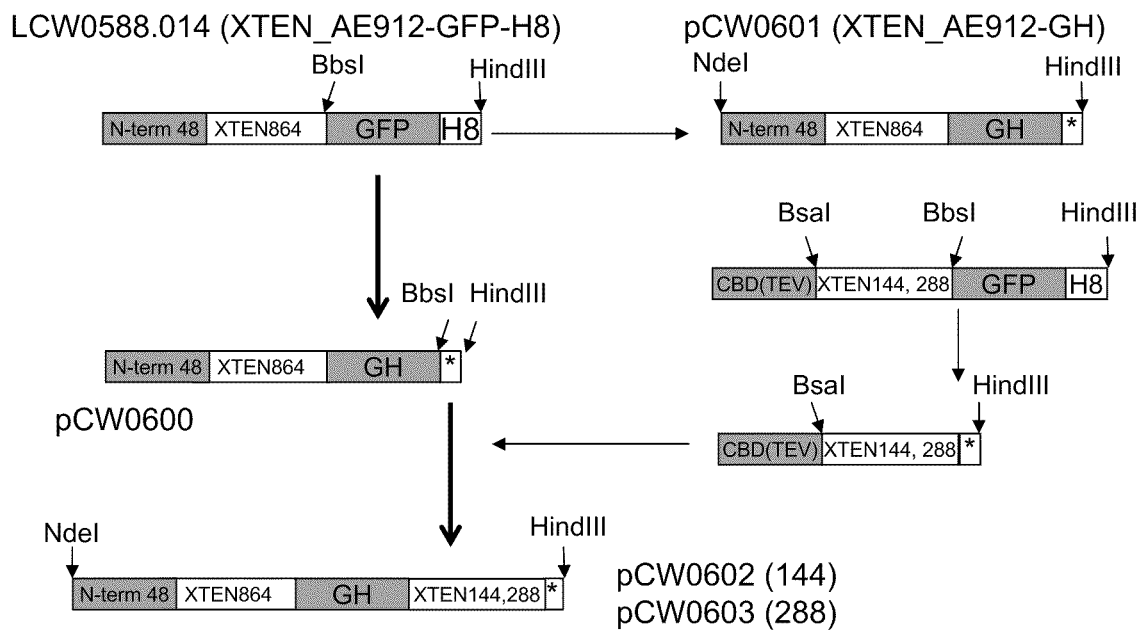
FIG. 8 is a schematic representation of the step-wise construction of GHXTEN genes that contain N-terminal XTEN encoding sequences linked to GH and the subsequent linkage of sequences encoding either 144 or 288 XTEN linked to the C-terminus of XTEN, as described in Example 22.

The gene encoding hGH was amplified by polymerase chain reaction (PCR), which introduced BsaI and HindIII restriction sites that are compatible with the BbsI and HindIII sites that flank the stuffer in the pNTS-XTEN destination vector. The pNTS-XTEN_AE plasmid is a pET30 derivative from Novagen in the format of N-terminal XTEN expression sequence of 48 amino acids-XTEN-Stuffer, where Stuffer is green fluorescent protein (GFP) and XTEN can be any length from 36 to 576 or greater. Constructs were generated by replacing a stuffer sequence in pNTS-XTEN with the hGH-encoding fragment. The pNTS-XTEN features a T7 promoter upstream of NTS followed by an XTEN sequence fused in-frame upstream of the stuffer sequence. The XTEN sequences employed belong to family XTEN_AE and encode lengths that can include 36, 72, 144, 288, 576, 864, and 1296 amino acids. The stuffer fragment was removed by restriction digest using BbsI and HindIII endonucleases. Restriction digested hGH DNA fragment was ligated into the cleaved pNTS-XTEN vector using T4 DNA ligase and electroporated into BL21(DE3) Gold (Stratagene). In some cases, a second XTEN_AE sequence of 144 or 288 amino acids was ligated to the C-terminus of the hGH encoding gene, the steps of which are illustrated in FIG. 8. The gene encoding hGH was amplified by polymerase chain reaction (PCR), which introduced BsaI and HindIII (with additional BbsI in front of HindIII) restriction sites that are compatible with the BbsI and HindIII sites that flank the stuffer in the pNTS-XTEN destination vector. After restriction enzyme digestions, ligation and transformation, the resulting intermediate plasmid has the format of pNTS-XTEN-hGH with the BbsI/HindIII restriction sites at the C-terminus of hGH. The intermediate plasmid was further digested with BbsI and HindIII, ligated with the second XTEN_AE sequence of 144 or 288 amino acids flanked by BsaI and HindIII, placing the AE144 or the AE288 encoding sequences at the C-terminus of the XTEN-hGH gene, and transformed into BL21(DE3)Gold. Transformants were screened by DNA miniprep and the desired construct was confirmed by DNA sequencing. The final vectors, described above, yield the genes in configurations of either NTS_XTEN_hGH or NTS_XTEN_hGH_XTEN, under the control of a T7 promoter, as shown in FIGS. 7C and 7D.

Example 23

Purification of GHXTEN_AE Constructs

Protein Expression
The plasmids described above were transformed into BL21 (DE3)-Gold *E. coli* strain (Novagen) and plated on an LB-agar plate with the appropriate antibiotics and grown overnight at 37° C. A single colony was inoculated into 5 ml of TB125 medium and grown overnight at 37° C. The next day the inoculum was transformed into a 2 L vessel with 500 ml of TB125, and grown until an OD=0.6 was reached, followed by continued growth at 26° C. for 16 hr with 0.1 mM IPTG.

Cells were collected by centrifugation and the cell pellet was resuspended in 50 ml Buffer containing 5 mM Tris pH 8.0, 100 mM NaCl. Cells were disrupted using an APV-2000 homogenizer. The pH of the lysate was then adjusted to pH 4.5 with acetic acid to precipitate contaminating host cell proteins and was subsequently clarified by centrifugation. The clarified, acid-treated lysate was then applied to a DE52 Anion exchange chromatography column and eluted with NaCl. The eluted fraction was then further acidified to pH 4.2 and applied to a MacroCapSP cation exchange chromatography column. Product was eluted using sequential elution with NaCl. An additional chromatography step employing Macrocap Q was implemented to remove product-related aggregates and residual host cell impurities (e.g. endotoxin, DNA, host cell protein).

Protein purity was estimated to be above 98%. The quantity of eluted fusion protein was determined by SDS-PAGE analysis and by measurement of total protein concentration. The high quantity of eluted GHXTEN fusion protein reflects the higher degree of solubility of the fusion protein relative to hGH not linked to XTEN (see, e.g., Singh, S. M., et al. (2005) *J Biosci Bioeng*, 99: 303; Patra, A. K., et al. (2000) *Protein Expr Purif*, 18: 182), as well as the ability to remain soluble at acidified conditions that result in the precipitation of host cell protein.

Final Formulation and Storage
The buffer exchanged proteins were then concentrated using 10K MWCO Vivacell 100 centrifugal ultrafiltration

Example 24

Characterization of GHXTEN Constructs

SDS-PAGE Analysis

5 µg of final purified GHXTEN proteins of GH linked to Y576 (either N- or C-terminus of Y576) was animaled to both non-reducing and reducing SDS-PAGE using NuPAGE 4-12% Bis-Tris gel from Invitrogen according to manufacturer's specifications. The resulting gel is shown in FIG. 20.

Analytical Size Exclusion Chromatography

Size exclusion chromatography analysis was performed using a TSKGel-G4000 SWXL (7.8 mm×30 cm) column. 20 ug of the purified protein at a concentration of 1 mg/ml was separated at a flowrate of 0.6 ml/min in 20 mM phosphate pH 6.8, 114 mM NaCl. Chromatogram profiles were monitored using OD214 nm and OD280 nm Column calibration was performed using a size exclusion calibration standard from BioRad, the markers include thyroglobulin (670 kDa), bovine gamma-globulin (158 kDa), chicken ovalbumin (44 kDa), equine myoglobuin (17 kDa) and vitamin B12 (1.35 kDa). The chromatographic profiles of Y576-GH were generated and demonstrate that the apparent molecular weight of each construct is significantly larger than that expected for a globular protein, in comparison to the standard proteins run in the same assay (data not shown).

Analytical RP-HPLC

Analytical RP-HPLC chromatography analysis was performed using a C4 (7.8 mm×20 cm) column. The column was equilibrated with 100% AcetonNitrile plus 0.1% TFA in the mobile phase at a flowrate of 1 ml/min. Twenty micro gram of the purified protein, with and without denaturing, at a concentration of 0.2 mg/ml was injected separately. The protein was separated and eluted by liner gradient within 15 min from 5% to 60% of buffer containing HPLC grade H20 plus 0.1% TFA. Chromatogram profiles were monitored using OD214 nm and OD280 nm.

Example 25

ELISA-Based Binding Assays

Figure 15:
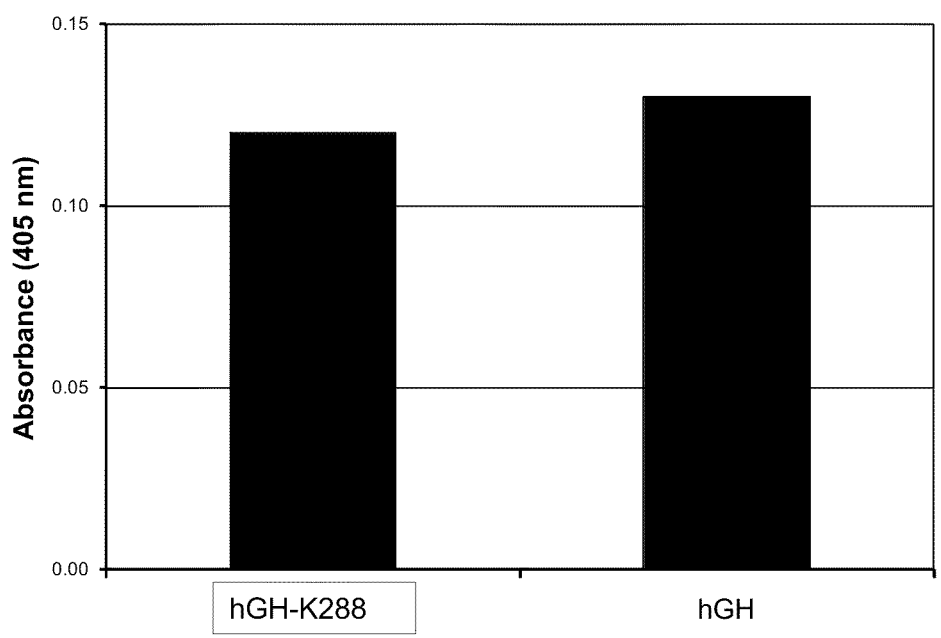
FIG. 15 shows the results of a receptor binding assay for hGH in which the binding activity of hGH fused to K288 polypeptide is compared to free hGH, as described in Example 25.
Figure 16:
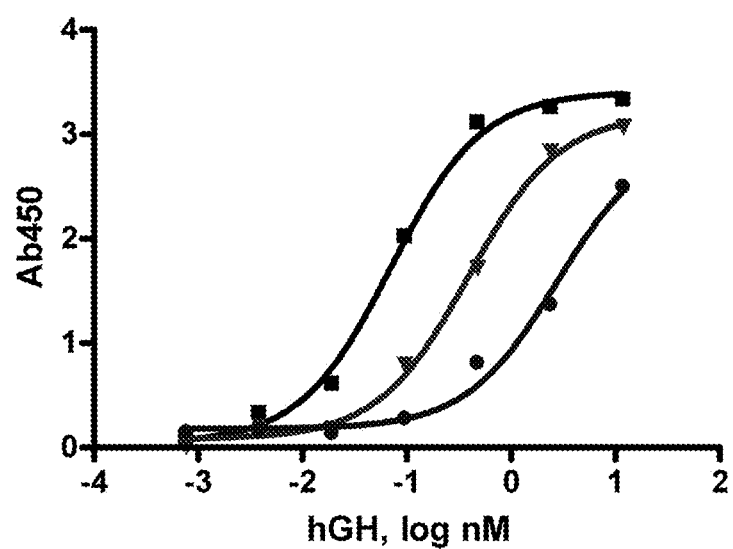
FIG. 16 shows the results of in vitro binding affinity assay of hGH-AM864 (circles) and AM864-hGH (inverted triangles) to hGHR-Fc, as described in Example 25. Unmodified recombinant hGH (squares) is shown for comparison.
Figure 18:
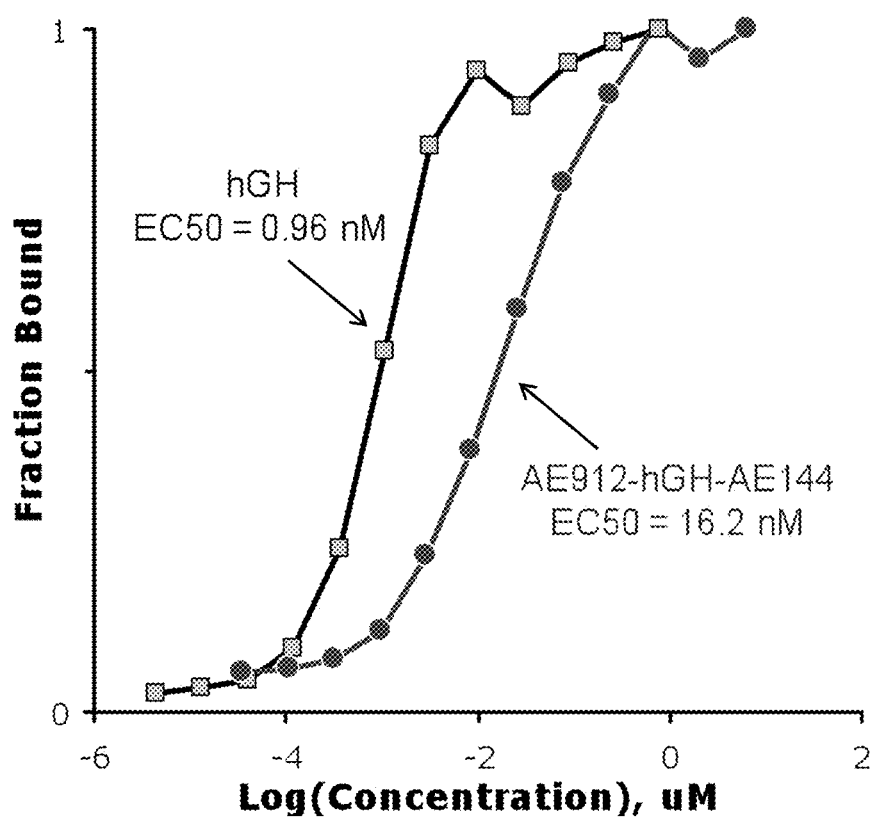
FIG. 18 shows results of an ELISA-based assay to determine the ability of addition of a C-terminus XTEN to reduce binding affinity of GHXTEN to bind to GH receptor, as described in Example 25.
Figure 19:
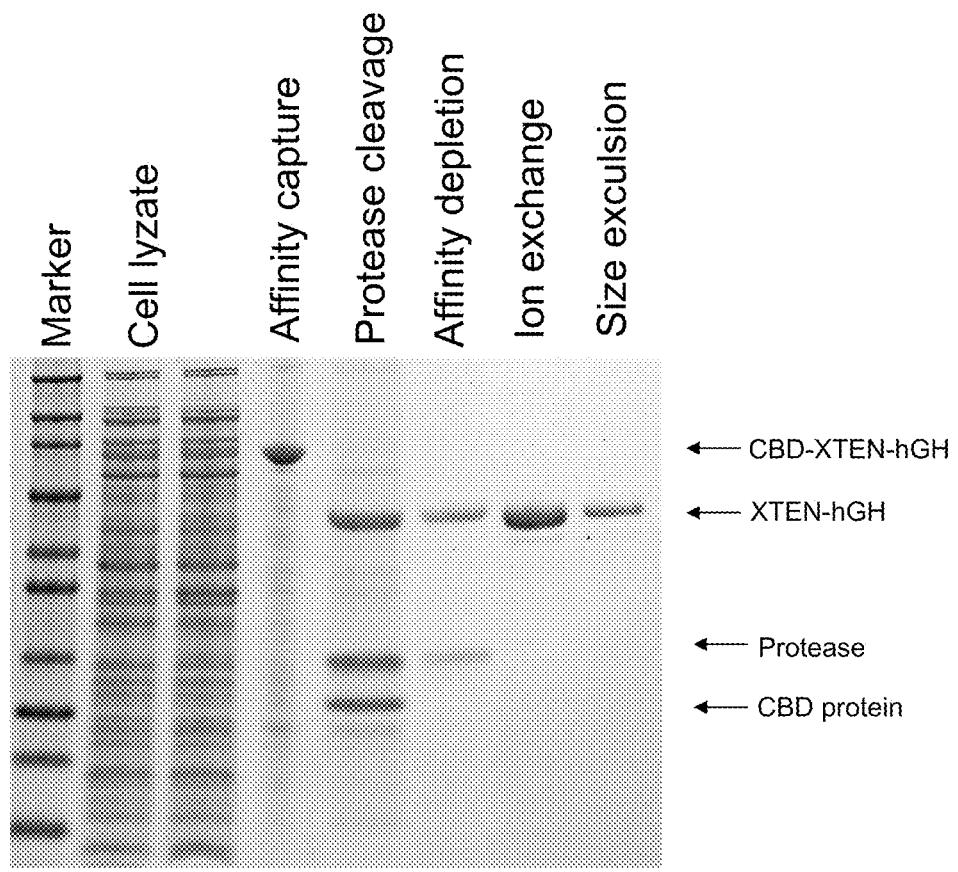
FIG. 19 shows SDS-PAGE analysis of hGH fused to K288, with samples from throughout the purification process, as described in Example 19.

XTEN fusions to GH were tested in a standard ELISA-based assay to evaluate their ability to bind to GH Receptor. Assays were performed using a sandwich ELISA format in which a recombinant hGH receptor (hGHR-Fc) is coated onto wells of an ELISA plate. The wells were then blocked, washed, and GHXTEN samples are then incubated in the wells at varying dilutions to allow capture of the GHXTEN. Wells were washed extensively, and bound protein was detected using a biotinylated preparation of a polyclonal or monoclonal anti-GH or anti-XTEN antibody and streptavidin HRP. The fraction of bound protein can be calculated by comparing the colorimetric response at each serum dilution to a standard curve of unmodified GH. In a first assay comparing hGH bound to K288 compared to recombinant hGH, the results, show in FIG. 15, demonstrate the ability of GHXTEN to bind to the hGH receptor. In a second assay, two configurations of GHXTEN; AM864-hGH and hGH-AM864; compared to recombinant hGH. The results, shown in FIG. 16, indicate apparent EC50 values for native hGH of 0.0701 nM, AM864-hGH of 0.3905, and hGH-AM864 of 2.733. In a third assay, recombinant hGH was compared to AE912-hGH-AE144 in order to show the ability to reduce binding affinity by the addition of a C-terminal XTEN to the hGH component of an GHXTEN fusion protein, and the results (FIG. 18) demonstrate a decrease in binding affinity of approximately 17-fold compared to hGH.

Example 26

Effect of Heat Treatment on the Stability of hGH and GHXTEN

The ability of XTEN to confer structural stability on the attached therapeutic molecule was investigated. Samples of hGH and AM864-hGH were incubated at 25° C. and 80° C., and then analyzed by gel electrophoresis and Coomassie staining. FIG. 17A is an SDS-PAGE gel of the two preparations treated at 25° C. and 80° C. for 15 minutes, while FIG. 17B shows the corresponding percentage of receptor binding activity of the 80° C. sample relative to the 25° C. treatment. The results indicate that hGH denatures under the treatment conditions while the GHXTEN construct remains largely stable under the experimental conditions, retaining nearly 80% of its receptor binding activity.

Conclusions: The XTEN component of the GHXTEN fusion protein confers enhanced solubility and stability properties to the fusion protein in comparison to hGH not linked to XTEN.

Example 27

Comparative Effects of hGH and AM864-hGH on Secretion of IGF-1

Figure 24:
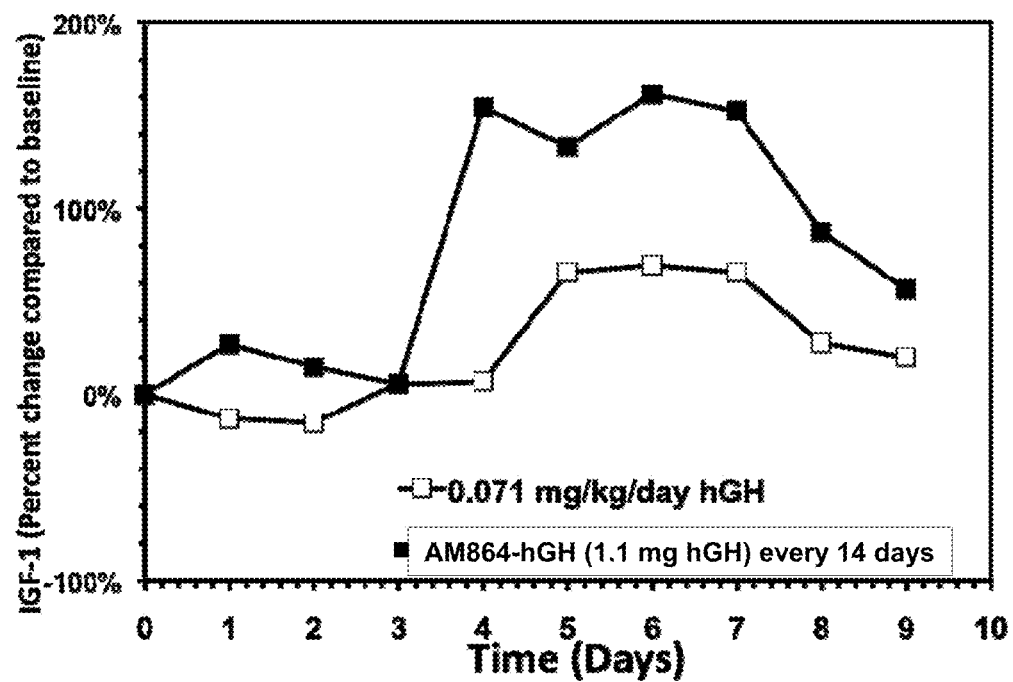
FIG. 24 shows the results of IGF-1 secretion in cynomolgus monkeys in response to administration of hGH or the GHXTEN AM864-hGH at the doses indicated, as described in Example 27.

The ability of a GHXTEN to retain pharmacologic potency was assessed using the measured parameter of circulating IGF-1 in response to administered compound. FIG. 24 shows the effects of daily administration of hGH (0.071 mg/kg daily) or a single dose of AM864-hGH (5 mg/kg; equivalent to 1.1 mg/kg) on circulating IGF-1 levels in cynomolgus monkeys (n=4/group), depicted as percentage change compared to baseline. The results show enhanced activity by the GHXTEN construct, despite being dosed only once at the beginning of the experiment.

Example 28

Comparative Effects of hGH and AM864-hGH on Body Weight Gain

Figure 25:
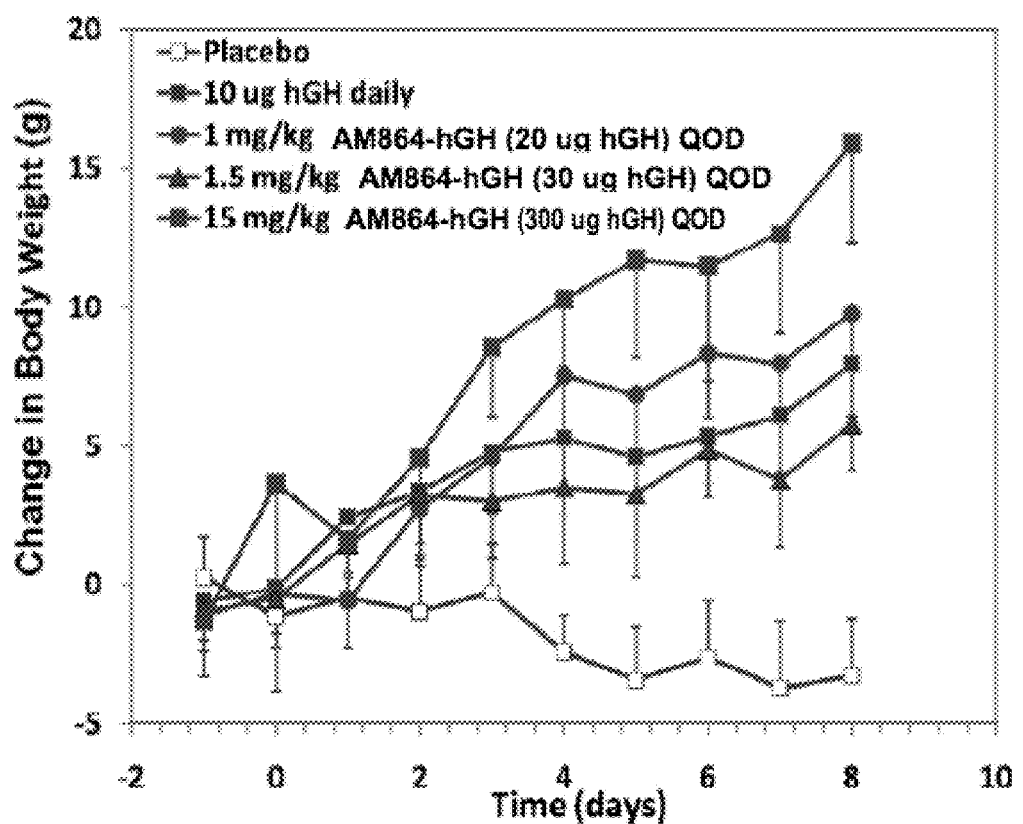
FIG. 25 shows the effects of administration of hGH or AM864-hGH at the indicated doses on body weight in a hypox rat model, as described in Example 28. The results show retention of biologic activity by the GHXTEN constructs that is equivalent in potency to hGH, yet with less frequent dosing.

The ability of a GHXTEN to retain pharmacologic potency was assessed using the measured parameter of body weight gain in a hypox rat in response to administered compound. FIG. 25 shows the effects of administration of hGH or AM864-hGH at the indicated doses and dose frequency on body weight in hypox rats. The results show retention of biologic activity by the GHXTEN constructs that is equivalent in potency to comparable dosage of hGH, yet with less frequent dosing. Increased dosage of AM864-hGH led to increases in body weight gains showing enhancement of the pharmacodynamic properties of the GHXTEN compared to hGH under these conditions.

Example 29

Comparative Effects of hGH and AM864-hGH on Bone Cartilage

The ability of a GHXTEN to retain pharmacologic potency was assessed using the measured parameter of increase in tibial epiphyseal plate width in hypox rats. FIG. 26 shows the comparative effects of administration of placebo, hGH, and AM864-hGH, shown in histologic cross-sections of the tibia from rats after 9 days of treatment, with the margins denoted with dotted lines. Groups are the same as shown in FIG. 26. FIG. 26A shows that the placebo group had an average cross-section width of 344±38.6 μm of the plate after 9 days. FIG. 26B shows that the hGH group (10 μg daily) had an average cross-section width of 598±8.5 μm after 9 days. FIG. 26C shows that the AM864-hGH (15 mg/kg q3d) had an average cross-section width of 944±8.5 μm after 9 days. The results show enhanced activity by the GHXTEN construct compared to hGH, despite being dosed at less frequent intervals.

Example 30

PK Analysis of GHXTEN Protein Fusions

GH-Y576 and Y576h-GH (in this case indicating the N- to C-terminus order of GH and XTEN) were injected into cynomolgus monkeys in order to determine in vivo pharmacokinetic parameters. The compositions were provided in an aqueous buffer and were administered by intravenous routes into separate animals at 0.15 mg/kg dosing. Serum samples were collected at various time points following administration and analyzed for serum concentrations of the accessory proteins. Analysis was performed using a sandwich ELISA format. Rabbit polyclonal anti-XTEN (to Y-type XTEN) antibodies were coated onto wells of an ELISA plate. Serum samples were then incubated in the wells at varying dilutions to allow capture of the compound by the coated antibodies. Wells were washed extensively, and bound protein was detected using a biotinylated preparation of the polyclonal anti-XTEN antibody and streptavidin HRP. Serum protein concentrations were calculated at each time point by comparing the colorimetric response at each serum dilution to a standard curve. Pharmacokinetic parameters were calculated using the WinNonLin software package.

Figure 22:
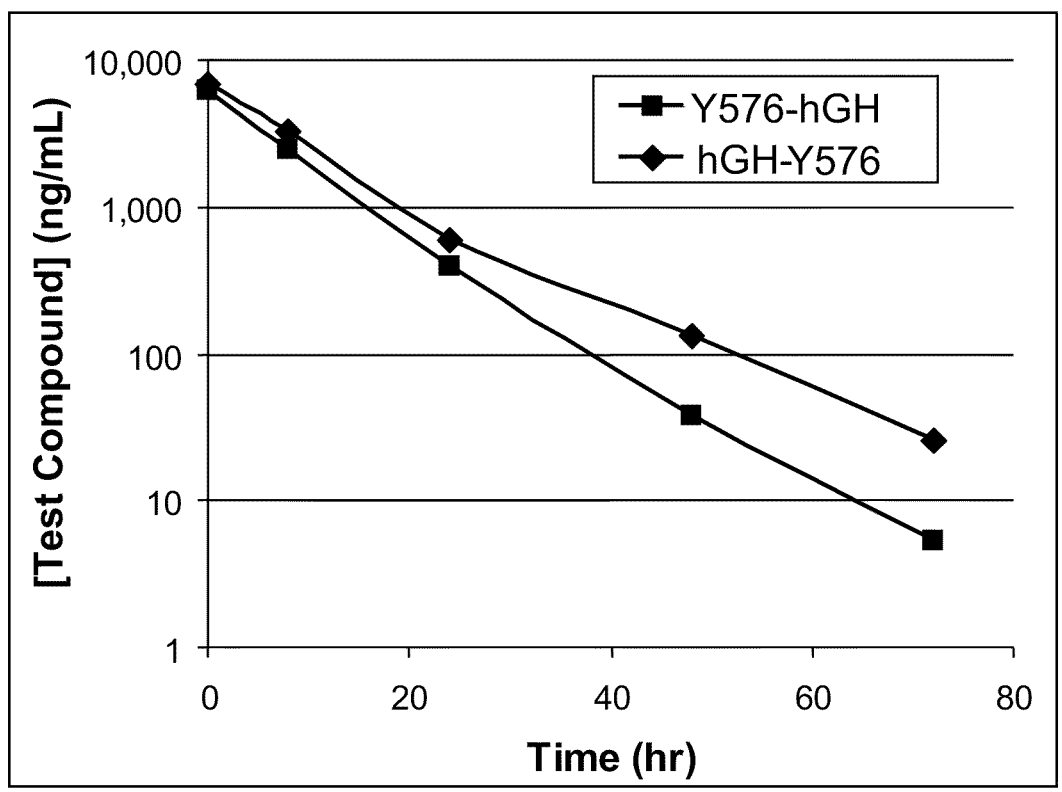
FIG. 22 shows the pharmacokinetic profile of two GHXTEN constructs Y576-GH and hGH-Y576 (N- to C-terminus) following intravenous administration to cynomolgus monkeys, as described in Example 30. The results show that the orientation (N-versus C-terminal) of hGH relative to the XTEN did not affect the clearance of the fusion proteins.

FIG. 22 shows the concentration profile of the two GH constructs following intravenous administration to cynomolgus monkeys. Following IV administration, the half-life was calculated to be 7 hours for hGH-Y576 and 10.5 hours for Y576-hGH. For reference, the published half-life of unmodified GH is well described in the literature as 10-15 minutes in adult humans (see, e.g., Hindmarch, P. C., et al., Clinical Endocrinology (2008) 30(4): 443-450). The results show that the orientation (N-versus C-terminal) of hGH relative to the XTEN did not affect the clearance of the fusion proteins, and that addition of the Y576 greatly extended the terminal half-life of the fusion protein.

Figure 23:
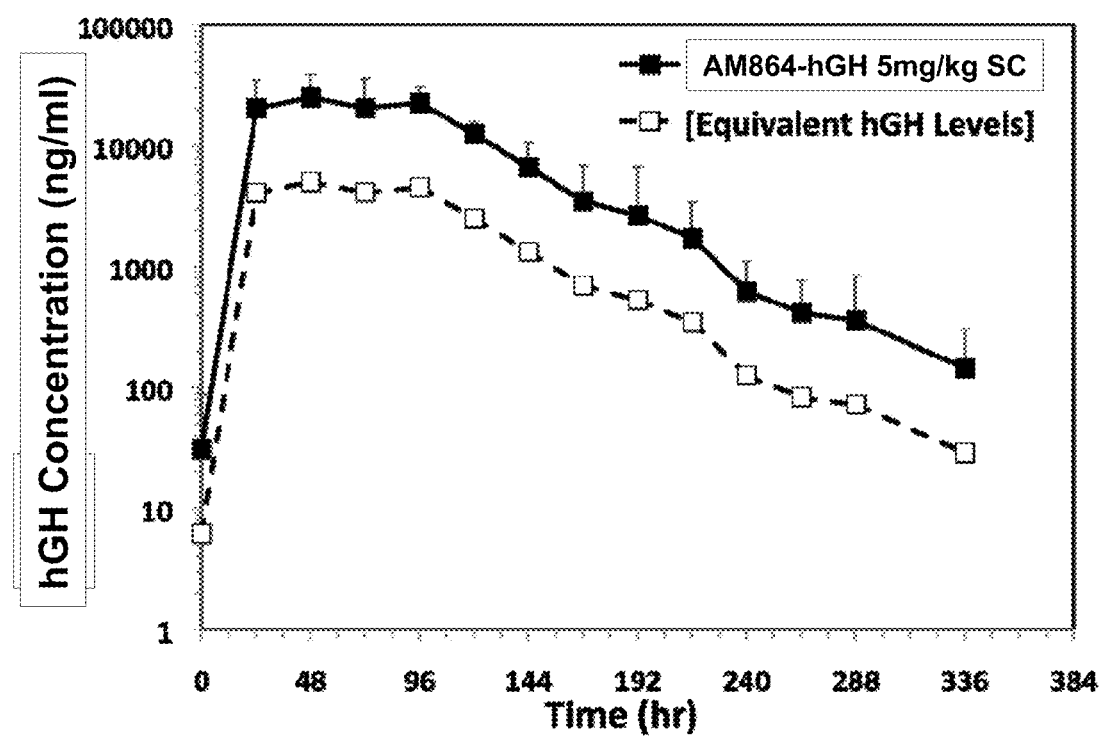
FIG. 23 shows the pharmacokinetic profile after a single dose of 5 mg/kg AM864-hGH administered subcutaneously to cynomolgus monkeys, with the derived equivalent hGH concentration shown (dashed line), as described in Example 30. Terminal half-life was calculated as 33 hours by WinNon-Lin using a single compartment fit.

Another pharmacokinetic study in cynomolgus monkeys was performed using the AM864-hGH construct. FIG. 23 shows the pharmacokinetic profile after a single dose of 5 mg/kg AM864-hGH administered subcutaneously to cynomolgus monkeys, with the derived equivalent hGH concentration shown (dashed line).

The XTEN component of the GHXTEN fusion protein confers enhanced pharmacokinetic properties to the fusion protein in comparison to hGH not linked to XTEN, under these conditions.

Example 31

PK Analysis of hGH XTEN Fusion Polypeptides in Rats

The GHXTEN fusion proteins AE912-hGH, AM864-hGH (synonym to AM875-hGH for this and following Examples), AE912-hGH-AE144 and AE912-hGH-AE288 were evaluated in rats in order to determine in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package.

Figure 27:
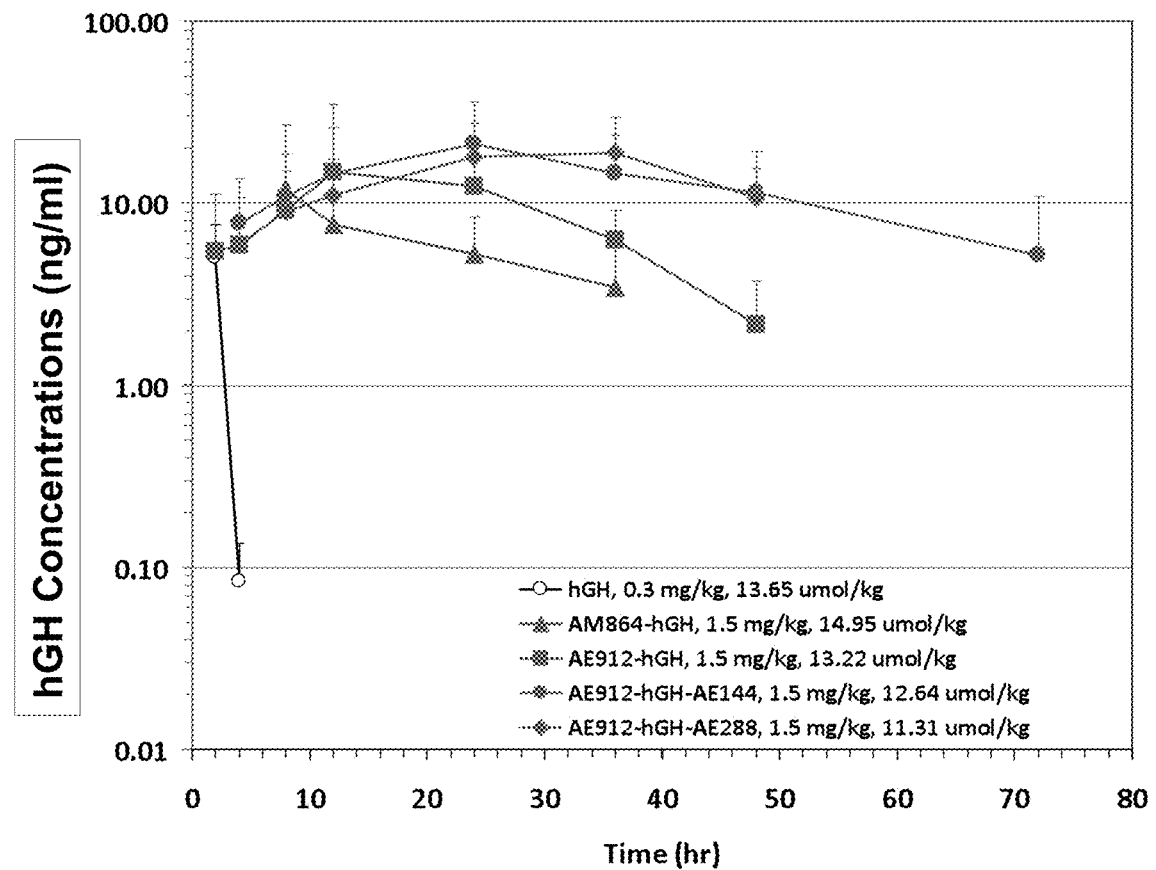
FIG. 27 shows the pharmacokinetic results of four hGH GHTXEN fusion proteins administered to rats by the subcutaneous route, compared to unmodified recombinant hGH, as described in Example 31.

FIG. 27 shows the concentration profiles of the four hGH XTEN constructs after subcutaneous administration. The calculated terminal half-life for AE912-hGH was 7.5 h, 6.8 h for AM864-hGH (synonym for AM875-hGH), 12.4 h for AE912-hGH-AE144 and 13.1 h for AE912-hGH-AE288. For comparison, unmodified hGH was run in parallel in the same experiment and showed a dramatically shorter plasma half-life.

The incorporation of different XTEN sequences into fusion proteins comprising hGH results in significant enhancement of pharmacokinetic parameters for all four compositions compared to unmodified hGH, as demonstrated in the rodent model under these conditions. The addition of a second XTEN protein to the C-terminus of the AE-hGH constructs results in a further enhancement of the terminal half-life compared to the constructs with a single XTEN; likely due to reduced receptor mediated clearance.

Example 32

PK Analysis of hGH XTEN Fusion Polypeptides in Cynomolgus Monkeys

Figure 28:
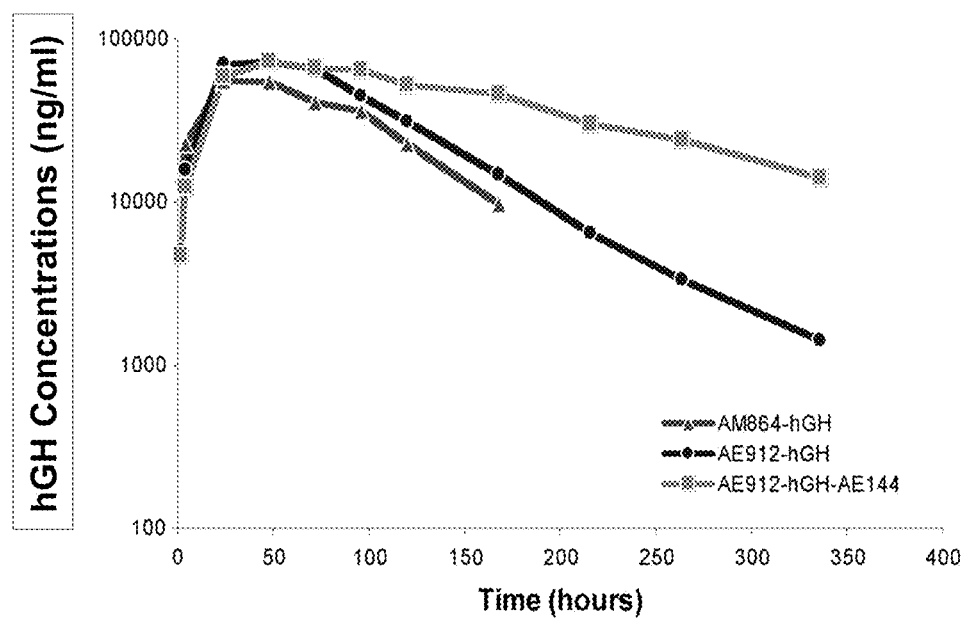
FIG. 28 shows the concentration profiles of three hGH XTEN constructs after subcutaneous administration to cynomolgus monkeys, as described in Example 32.

GHXTEN fusion proteins containing one or two XTEN molecules (AE912-hGH, AM864-hGH, and AE912-hGH-AE144) were evaluated in cynomolgus monkeys in order to determine the effect of the inclusion of a second XTEN on in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package, and FIG. 28 shows the concentration profiles of the three hGH XTEN constructs after subcutaneous administration over the 336 h period. The average terminal half-life for the fusion proteins were 33 h for AM864-hGH, 44 h for AE912-hGH, and 110 h for the AE912-hGH-AE144 (containing two XTEN linked to the N- and C-termini of hGH).

The incorporation of different XTEN sequences into fusion proteins comprising hGH resulted in significant enhancement of pharmacokinetic parameters for all three compositions, as demonstrated in the cyno model under these conditions, with the construct containing a second XTEN linked to the C-terminus of the hGH showing a greater than about two-fold enhancement of the terminal half-life compared to the GHXTEN with a single XTEN at the N-terminus.

Example 33

Figure 29:
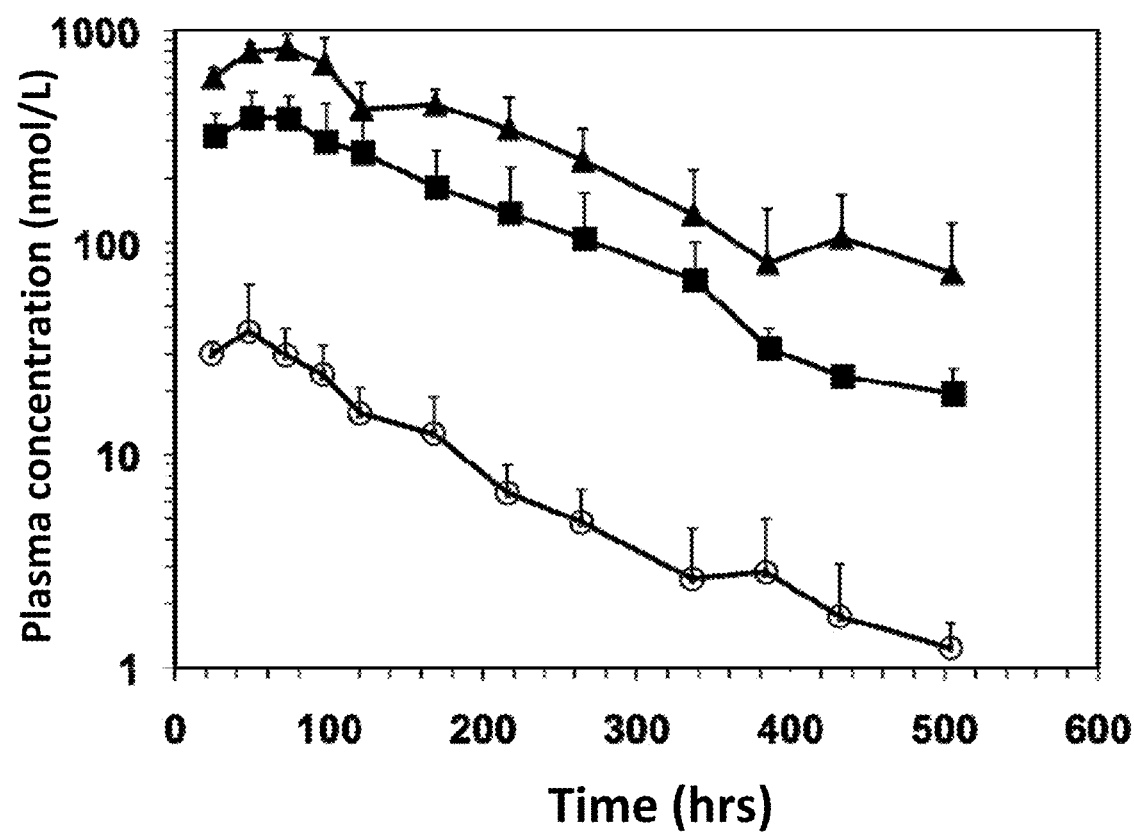
FIG. 29 shows the results of a pharmacokinetic study of three doses levels of the GHXTEN AE912-hGH-AE144 administered to male and female cynos SC at 0.3 (open circles), 1.5 (squares), and 7.5 mg/kg (triangles), as described in Example 33.
Figure 30:
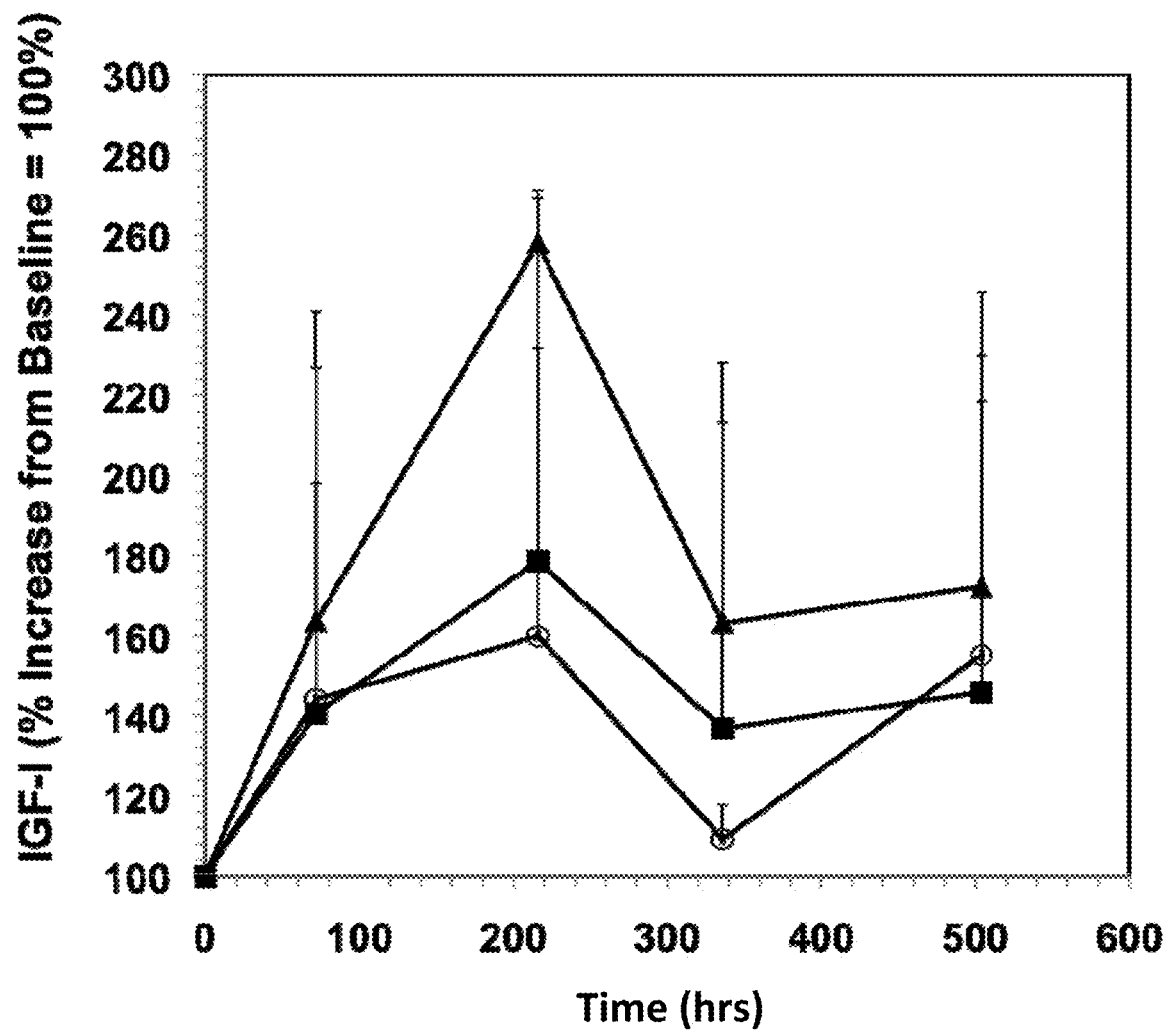
FIG. 30. Shows the results of IGF-1 levels in cynos in response to the administration of AE912-hGH-AE144, as described in Example 33 (same groups as per FIG. 29).

Assessment of Pharmacodynamic Effects of AE912-hGH-AE144 GHXTEN by Measurement of IGF-1 Response in Cynomolgus Monkeys AE912-hGH-AE144 was administered to male and female cynos SC at 0.3, 1.5, and 7.5 mg/kg and dose volumes ranging from 0.80 to 1.13 ml. Blood samples (1.0 mL) were collected into prechilled heparinized tubes at predose, 2, 4, 8, 24, 48, 72, 96, 120, 168, 216, 264, 336, 388, 432, 504 hour timepoints (16), and processed into plasma. PK was measured by ELISA assay using the anti-XTEN capture antibody and the biotinylated anti-hGH detection antibody. IGF-1 samples were sent to and analyzed by Millipore. PK parameters were calculated by analysis using the WinNonLin software package and are shown in the table below. Plasma concentration profiles of the three doses of GHXTEN and IGF-1 levels are shown in FIG. 29 and FIG. 30, respectively (open circles=0.3 mg/kg; squares=1.5 mg/kg; triangles=7.5 mg/kg). The results show that administration of AE912-hGH-AE144 results in a sustained increase in IGF-1 levels, consistent with both the biological mode of action of growth hormone and the long plasma half-life of AE912-hGH-AE144.

TABLE 22

| PK parameters in cynomolgus monkeys | | | |
|---|---|---|---|
| | 0.3 mg/kg | 1.5 mg/kg | 7.5 mg/kg |
| Route | SC | SC | SC |
| T½ (hrs) | 84.4 | 97.5 | 101.1 |
| Cmax (nM) | 41 | 910 | 340 |
| AUC (nM * hr) | 5,170 | 162,000 | 64,100 |

Example 34

Figure 31:
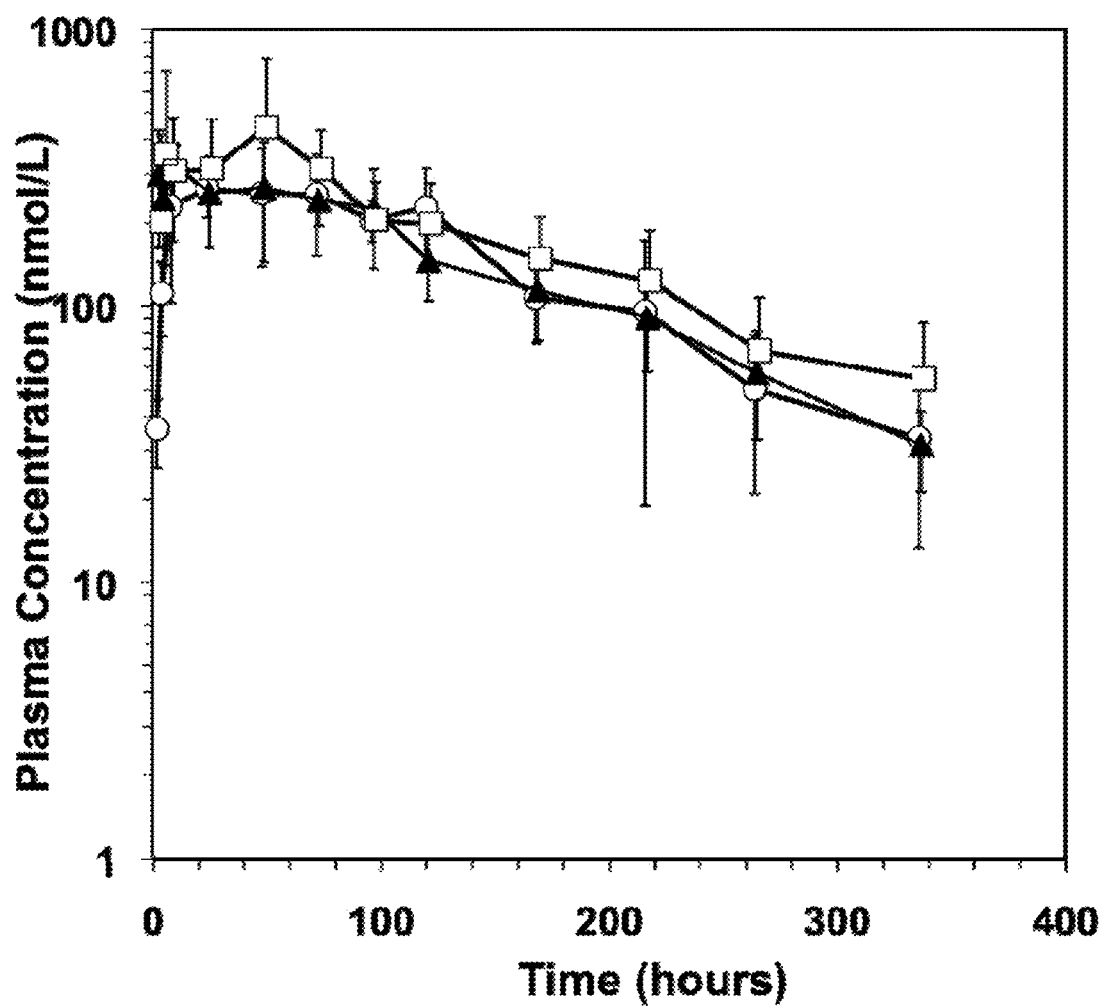
FIG. 31 shows the results of an experiment to compare bioavailability of the GHXTEN AE912-hGH-AE144 administered by three different routes, as described in Example 34. AE912-hGH-AE144 was administered to male and female cynos SC at 1.5 mg/kg via intravenous (triangle), subcutaneous (open circles), and intramuscular (squares) routes, with plasma concentrations of the GHXTEN shown in the figure.

Comparative Bioavailability of AE912-hGH-AE144 via Subcutaneous and Intramuscular Administration to Cynomolgus Monkeys AE912-hGH-AE144 was administered to male and female cynos SC at 1.5 mg/kg via intravenous, subcutaneous, and intramuscular routes. Blood samples (1.0 mL) were collected into prechilled heparinized tubes at predose, 2, 4, 8, 24, 48, 72, 96, 120, 168, 216, 264, 336, 388, 432, 504 hour timepoints (16), and processed into plasma. Plasma levels at each time point were measured by ELISA assay using the anti-XTEN capture antibody and the biotinylated anti-hGH detection antibody. PK and bioavailability parameters were calculated by analysis using the WinNonLin software package and are shown in the table below. Plasma concentration profiles are shown in FIG. 31 (open circles=subcutaneous; triangle=IV; squares=intramuscular). For bioavailability calculations, the AUC for intravenous administration was defined to be 100%. The results show that AE912-hGH-AE144 shows a high bioavailability and distributes rapidly from the injection site to the blood compartment following injection.

TABLE 23

| PK parameters in cynomolgus monkeys | | | |
|---|---|---|---|
| | 1.5 mg/kg | 1.5 mg/kg | 1.5 mg/kg |
| Route | SC | IV | IM |
| T½ (hrs) | 97.5 | 107.7 | 102.2 |
| Cmax (nM) | 910 | 462 | 245 |
| AUC (nM * hr) | 162,000 | 60,300 | 43,200 |
| Bioavailability | ~100% | 100% | 72% |

Example 35

Determination of the Therapeutic Window for AE912-hGH-AE144

Figure 32:
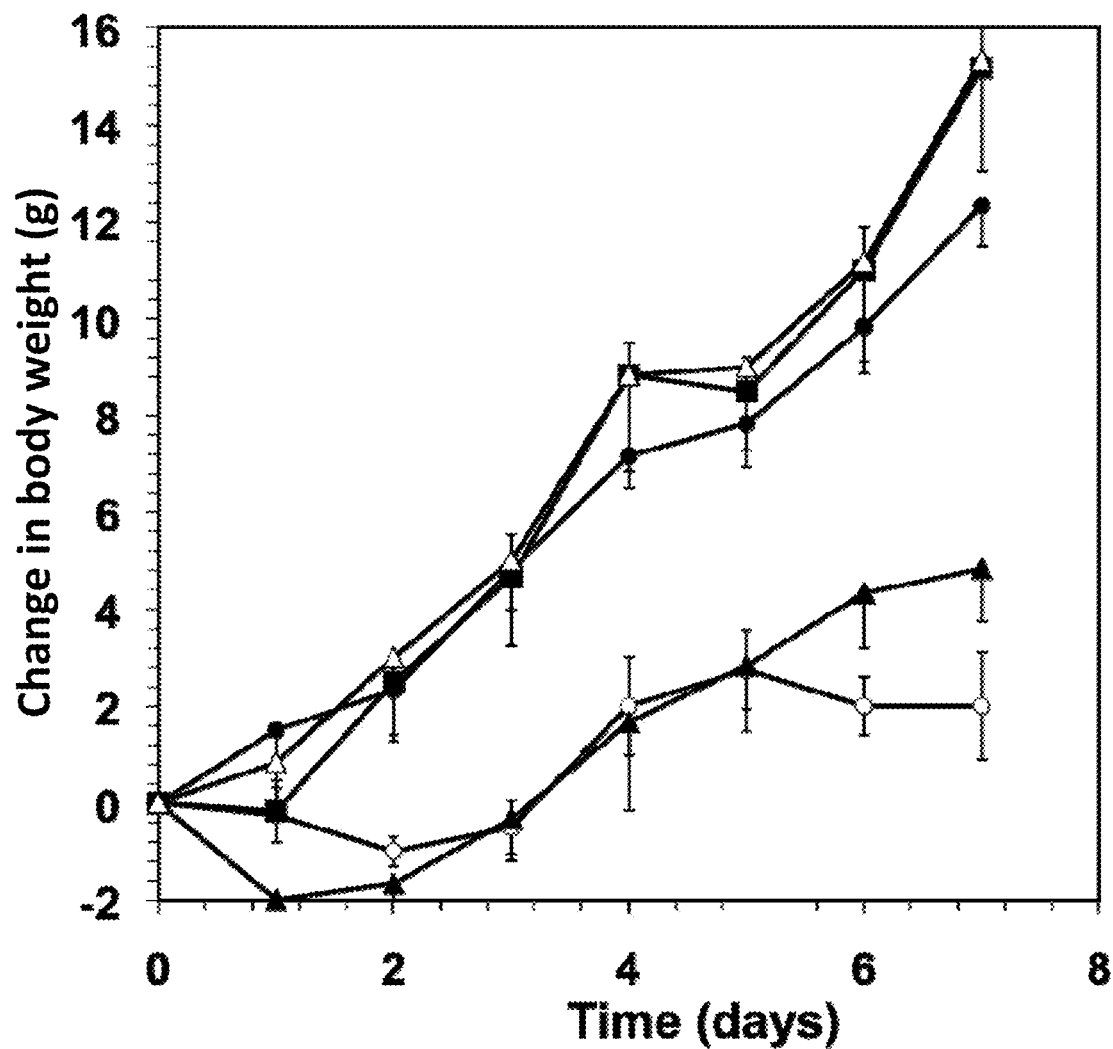
FIG. 32 shows the effects of administration of vehicle (open circles), recombinant hGH dosed at 5 nmol/kg/day (closed circles), the GHXTEN AE912-hGH-AE144 at varying doses and dose frequency (closed triangles=0.5 nmol/kg/day; open triangles=1.5 nmol/day; squares=3 nmol/kg/Q2D) on body weight in hypox rats, as described in Example 35.
Figure 33:
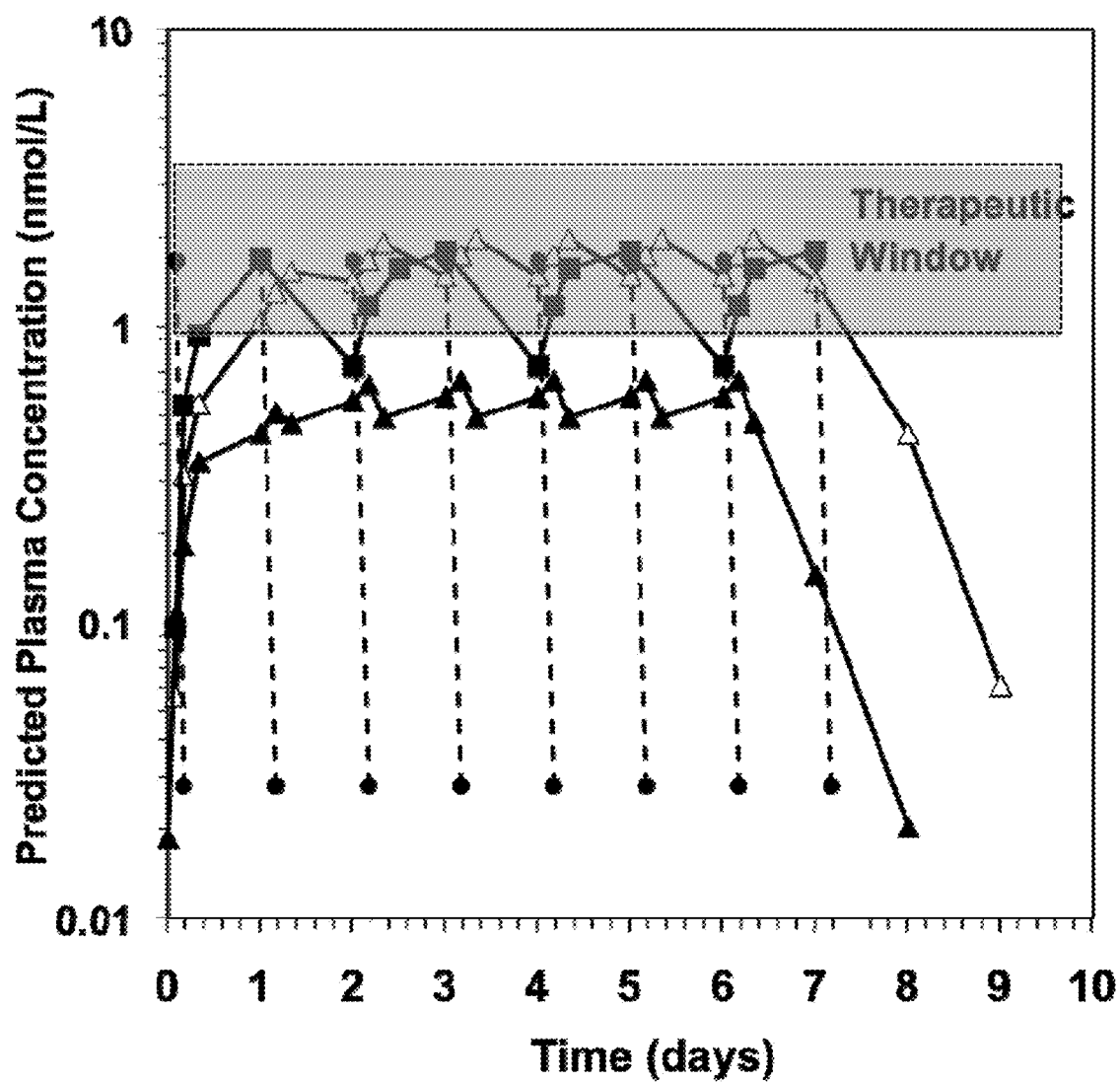
FIG. 33 shows results of a modeled projection of the ability of hGH or the GHXTEN to maintain blood levels within a therapeutic window in the hypox rat model, based on results derived from the data portrayed in FIG. 32, using the same dosing groups.

The specific activity of the GHXTEN AE912-hGH-AE144 was assessed using the measured parameter of body weight gain in a hypophysectomized (hypox) rat in response to administered compound. FIG. 32 shows the effects of administration of vehicle (open circles), recombinant hGH dosed at 5 nmol/kg/day (closed circles), the GHXTEN AE912-hGH-AE144 at varying doses and dose frequency (closed triangles=0.5 nmol/kg/day; open triangles=1.5 nmol/day; squares=3 nmol/kg/Q2D) on body weight in hypox rats. The results show that a dose of the GHXTEN AE912-hGH-AE144 as low as 1.5 nmol/kg/day yields comparable growth to hGH alone. However, a lower dose of 0.5 nmol/kg/day does not promote growth in these animals. Based on the pharmacokinetic profiles determined in the rats, a model for plasma levels following repeat dosing was constructed as shown in FIG. 33 (same groups as per FIG. 32). The model clearly differentiates the efficacious doses from the non-efficacious lower dose. The results show that plasma concentration of AE912-hGH-AE144 generally should remain above about 1 nmol/L concentration in order to maintain optimal growth in the hypophysectomized rat model.

Example 36

Clinical Field Trial Designs for Evaluating GHXTEN

Clinical trials can be designed such that the efficacy and advantages of the GHXTEN compositions, relative to the corresponding growth hormone biologics, can be verified in animals. For example, the GHXTEN fusion constructs comprising growth, as described in the Examples above, can be used in trials for characterizing the efficacy of the compositions. The trials can be conducted to assess one or more conditions or physiologic effects that are improved by the administration of growth hormone. Such studies are conducted to determine the maximum tolerated dose and pharmacokinetics and pharmacodynamics in animals (either normal animals or animals with a disease or condition), as well as to define potential toxicities and adverse events to be tracked in future studies. The study is conducted in which single rising doses of compositions of fusion proteins of GHXTEN or placebo are administered and biochemical, PK, and physiological parameters are measured. This permits the determination of the maximum tolerated dose and establishes the threshold and maximum concentrations in dosage and circulating drug that constitute the therapeutic window for the respective components and the net benefits that result from the administration of the GHXTEN. Parameters and clinical endpoints are measured as a function of the dosing of the fusion proteins compositions, yielding dose-ranging information on doses that would be appropriate for use of the GHXTEN in treatment of animals. achieve the study endpoints. Parameters that are monitored include GH, IGF-1 and IGFBP3 concentrations, changes in growth velocity, body mass, total body fat, muscle mass, bone growth, lactation, duration of lactation, hoof growth, lipolysis, and efficiency of converting feed to meat or milk, measurement of division and multiplication rates of chondrocytes, and/or changes in bone density and/or bone growth; parameters that would be tracked relative to the placebo or positive control groups. Efficacy outcomes would be determined using standard statistical methods. Toxicity and adverse event markers are also be followed in this study to verify that the compound is safe when used in the manner described.

Example 37

Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. construct is significantly larger than that expected for a globular protein (as shown by comparison to the standard proteins run in the same assay). Based on the SEC analyses for all constructs evaluated, including a GHXTEN composition, the Apparent Molecular Weights, the Apparent Molecular Weight Factor (expressed as the ratio of Apparent Molecular Weight to the calculated molecular weight) and the hydrodynamic radius ($R_H$ in nm) are shown in Table 24. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm Accordingly, it is expected that fusion proteins comprising growth and XTEN have reduced renal clearance, contributing to increased terminal half-life and improving the therapeutic or biologic effect relative to a corresponding unfused biologic payload protein.

TABLE 24

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Figure 34:
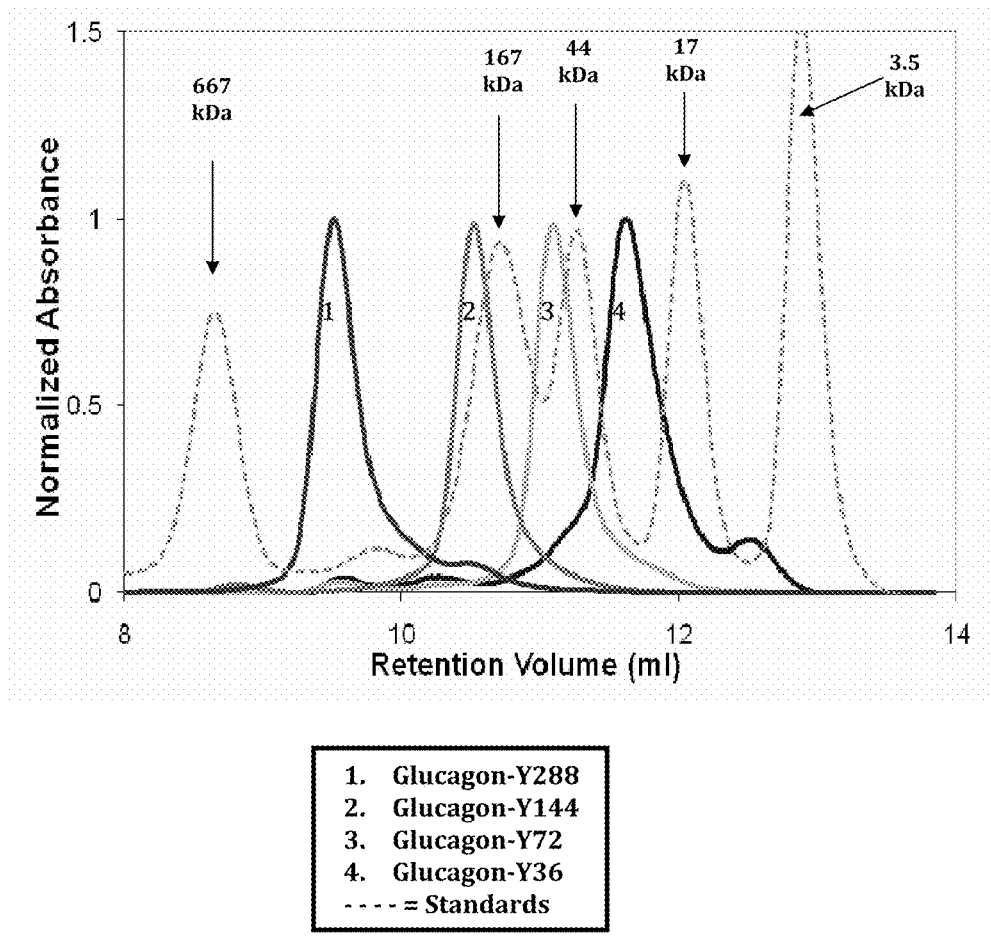
FIG. 34 shows results of a of a size exclusion chromatography analysis of glucagon-XTEN construct samples measured against protein standards of known molecular weight, with the graph output as absorbance versus retention volume, as described in Example 37. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety.

An exemplary assay used a TSKGel-G4000 SWXL (7.8 mm×30 cm) column in which 40 μg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 34. The data show that the apparent molecular weight of each compound is proportional to the length of the attached XTEN sequence. However, the data also show that the apparent molecular weight of each Example 38

Pharmacokinetics of Extended Polypeptides Fused to GFP in Cynomolgus Monkeys

Figure 35:
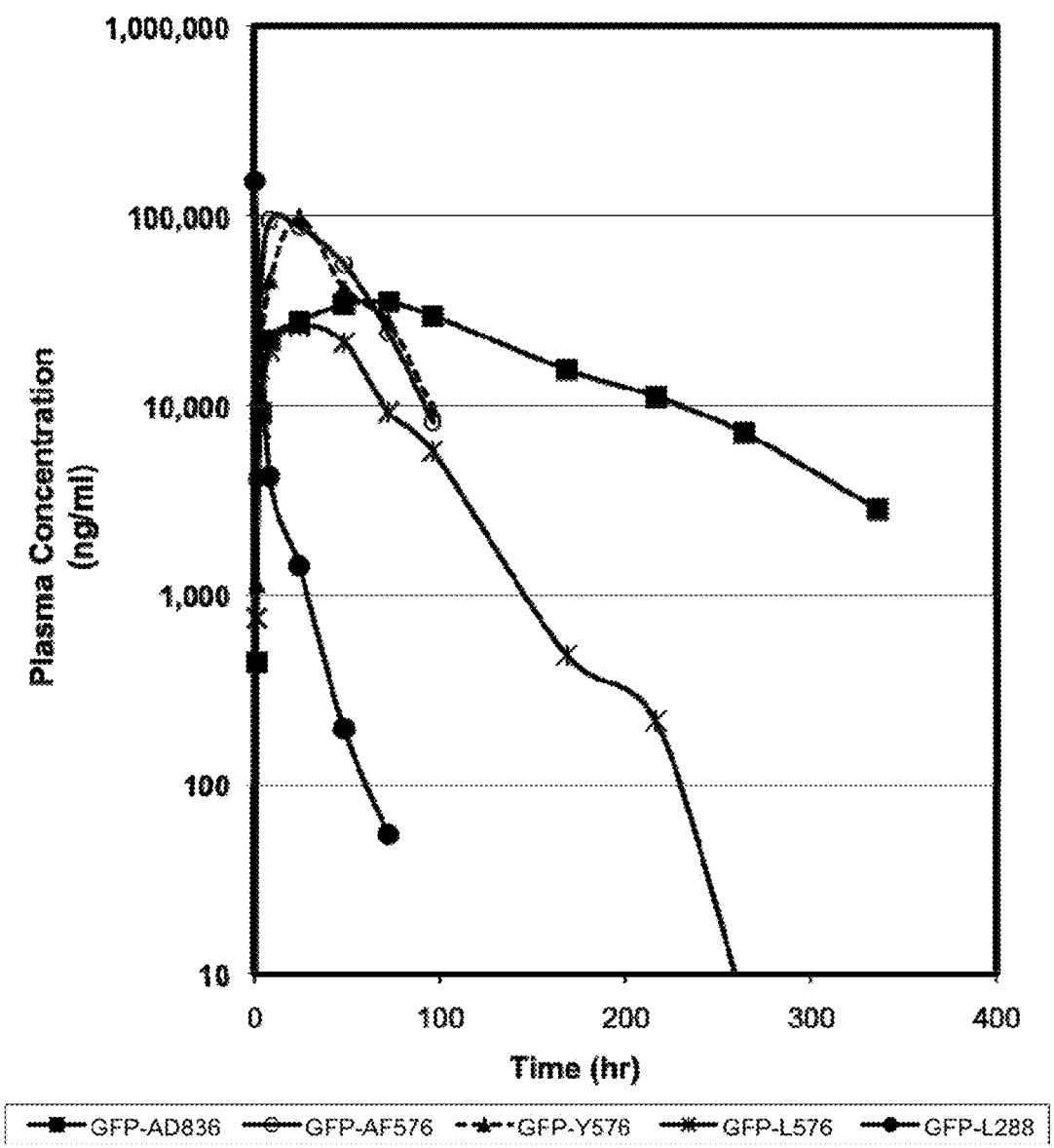
FIG. 35 shows the pharmacokinetic profile (plasma concentrations) in cynomolgus monkeys after single doses of different compositions of GFP linked to unstructured polypeptides of varying length, administered either subcutaneously or intravenously, as described in Example 38. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 35. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 39

Serum Stability of XTEN

Figure 14:
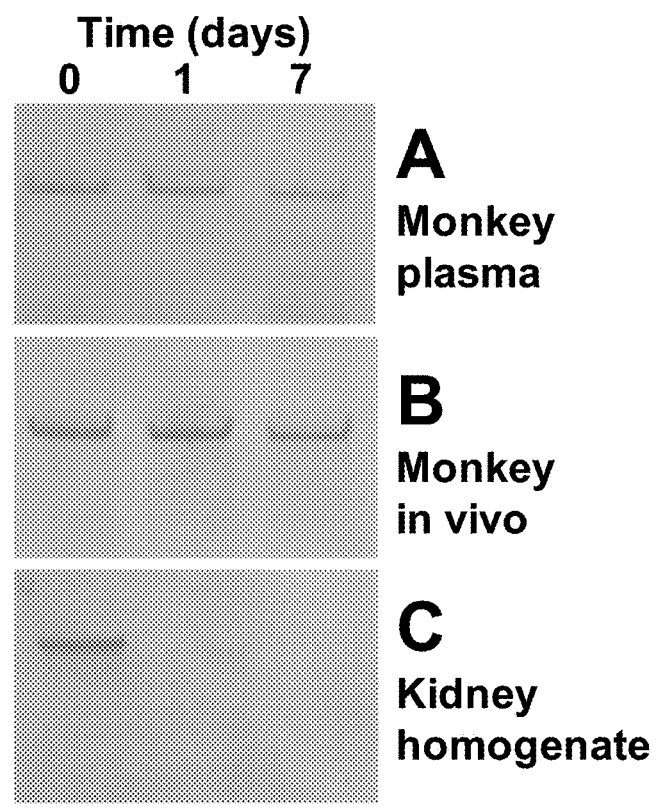
FIG. 14 shows an SDS-PAGE gel of samples from a stability study of the fusion protein of XTEN_AE864 fused to the N-terminus of GFP (see Example 39). The GFP-XTEN was incubated in cynomolgus plasma and rat kidney lysate for up to 7 days at 37° C. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 14. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of GHXTEN to degradation due to serum proteases; a factor in the enhancement of pharmacokinetic properties of the GHXTEN fusion proteins.

Example 40

Figure 36:
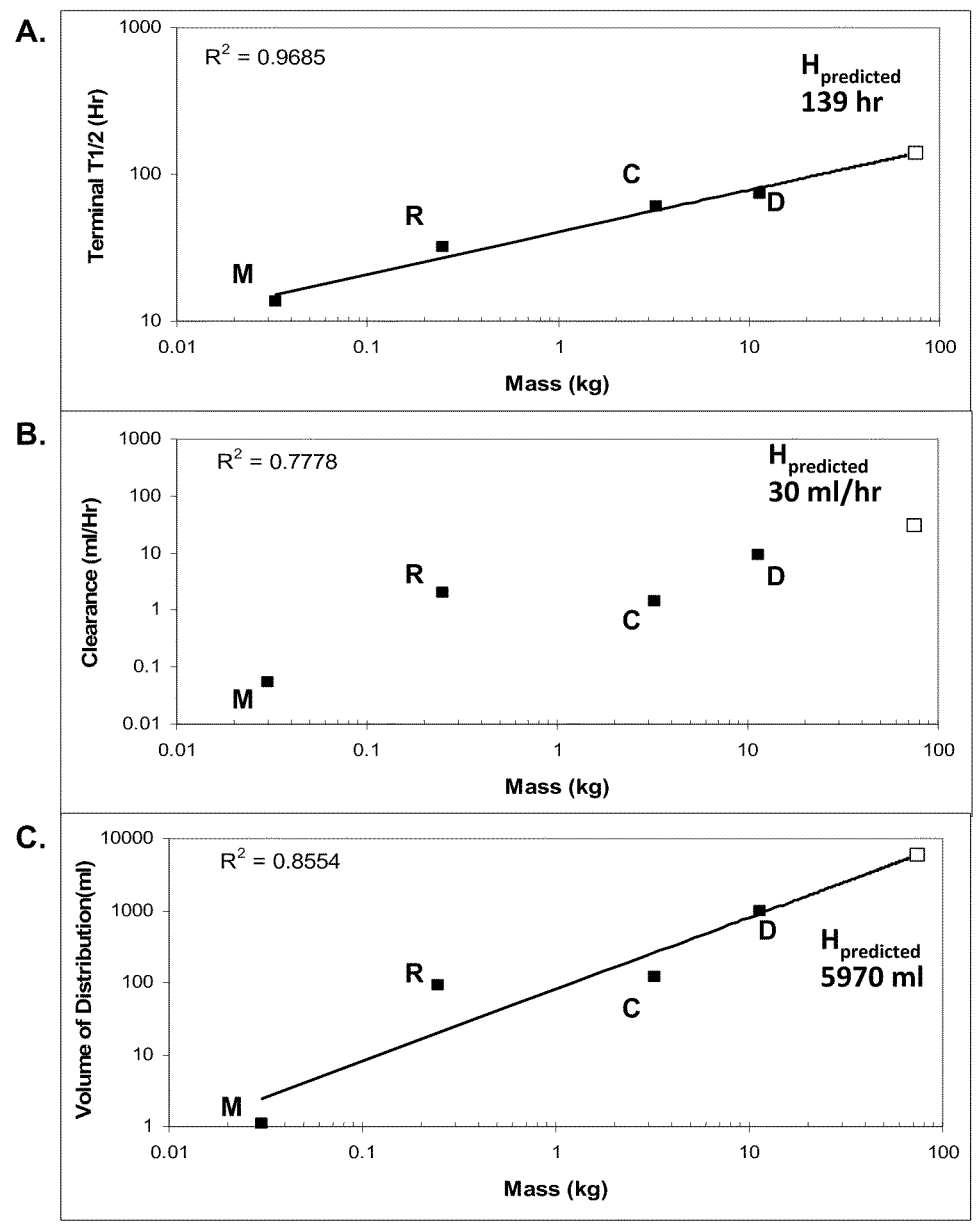
FIGS. 36A-C illustrate allometric scaling results for predicted human response to Ex-4-XTEN_AE864 based on measured results from four animal species; i.e., mice, rats, cynomolgus monkeys and dogs.

PK Analysis of Ex4-XTEN Fusion Protein in Multiple Species and Predicted Human Half-Life To determine the predicted pharmacokinetic profile in humans of a therapeutic protein fused to XTEN, studies were performed using exendin-4 fused to the AE864 XTEN as a single fusion polypeptide. The Ex4-XTEN construct was administered to four different animal species at 0.5-1.0 mg/kg, subcutaneously and intravenously. Serum samples were collected at intervals following administration, with serum concentrations determined using standard methods. The half-life for each species was determined, and is tabulated in Table 25. The results were used to predict the human half-life using allometric scaling of terminal half-life, volume of distribution, and clearance rates based on average body mass. FIG. 36A shows a plot of measured terminal half-life versus body mass in the animal species, with a predicted $T_{1/2}$ in a 75 kg human of 140 h, compared to the reported half-life of exenatide of 2.4 h (Bond, A. Proc (Bayl Univ Med Cent) 19(3): 281-284. (2006)). FIG. 36B shows measured drug clearance versus body mass, with a predicted clearance rate value of 30 ml/h in a 75 kg human. FIG. 36C shows measured volume of distribution versus body mass, with a predicted value of 5970 ml in a 75 kg human.

Conclusions:

It can be concluded from the results that addition of an XTEN to a glucose-regulating peptide, such as exendin-4, can greatly increase the terminal half-life compared to the peptide not linked to XTEN.

TABLE 25

Half-life of Ex4-XTEN

| Species | Half-Life (hr) |
|---|---|
| Mouse | 13.5 |
| Rat | 31.7 |
| Monkey | 60.7 |
| Dog | 72.8 |
| Human | 140* |

*Predicted value based on allometric scaling

Example 41

Increasing Solubility and Stability of a Peptide Payload by Linking to XTEN

In order to evaluate the ability of XTEN to enhance the physical/chemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 26. For comparative purposes, the solubility limit of unmodified glucagon in the same buffer was measured at 60 μM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144×TEN, the limit of solubility was determined, with the result that a 60-fold increase in solubility was achieved, compared to glucagon not linked to XTEN. In addition, the glucagon-AF144 GHXTEN was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 26

Solubility of Glucagon-XTEN constructs

| Test Article | Solubility |
|---|---|
| Glucagon | 60 μM |
| Glucagon-Y36 | >370 μM |
| Glucagon-Y72 | >293 μM |
| Glucagon-AF108 | >145 μM |
| Glucagon-AF120 | >160 μM |
| Glucagon-Y144 | >497 μM |
| Glucagon-AE144 | >467 μM |
| Glucagon-AF144 | >3600 μM |
| Glucagon-Y288 | >163 μM |

Example 42

Characterization of XTEN Fusion Protein Secondary Structure

Figure 21:
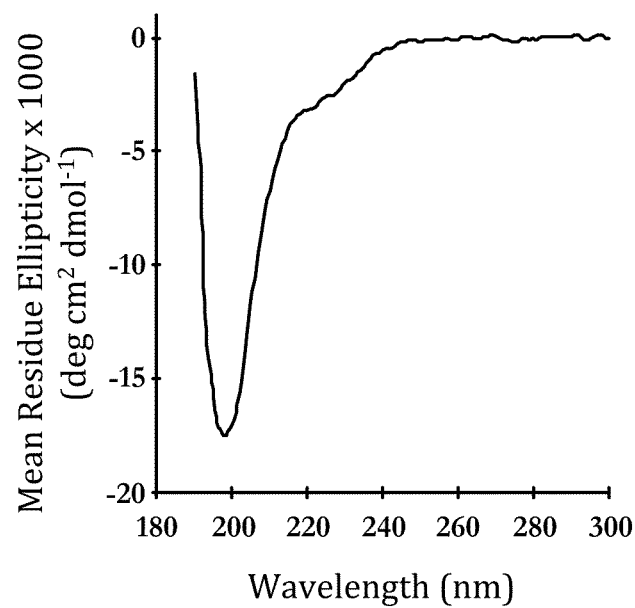
FIG. 21 shows the near UV circular dichroism spectrum of Ex4-XTEN_AE864, performed as described in Example 42.

The fusion protein Ex4-AE864 was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical pathlength of 0.1 cm. The CD spectra were acquired at 5°, 25°, 45°, and 65° C. and processed using the J-700 version 1.08.01 (Build 1) Jasco software for Windows. The samples were equilibrated at each temperature for 5 min before performing CD measurements. All spectra were recorded in duplicate from 300 nm to 185 nm using a bandwidth of 1 nm and a time constant of 2 sec, at a scan speed of 100 nm/min. The CD spectrum shown in FIG. 21 shows no evidence of stable secondary structure and is consistent with an unstructured polypeptide.

Example 43

Analysis of Sequences for Secondary Structure by Prediction Algorithms

Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 27.

The results indicate that, by the Chou-Fasman calculations, the four motifs of the AE family (Table 1) have no alpha-helices or beta sheets. The sequence up to 288 residues was similarly found to have no alpha-helices or beta sheets. The 432 residue sequence is predicted to have a small amount of secondary structure, with only 2 amino acids contributing to an alpha-helix for an overall percentage of 0.5%. The full-length AF864 polypeptide has the same two amino acids contributing to an alpha-helix, for an overall percentage of 0.2%. Calculations for random coil formation revealed that with increasing length, the percentage of random coil formation increased. The first 24 amino acids of the sequence had 91% random coil formation, which increased with increasing length up to the 99.77% value for the full-length sequence.

Numerous XTEN sequences of 500 amino acids or longer from the other motif families were also analyzed and revealed that the majority had greater than 95% random coil formation. The exceptions were those sequences with one or more instances of three contiguous serine residues, which resulted in predicted beta-sheet formation. However, even these sequences still had approximately 99% random coil formation.

In contrast, a polypeptide sequence of 84 residues limited to A, S, and P amino acids was assessed by the Chou-Fasman algorithm, which predicted a high degree of predicted alpha-helices. The sequence, which had multiple repeat "AA" and "AAA" sequences, had an overall predicted percentage of alpha-helix structure of 69%. The GOR algorithm predicted 78.57% random coil formation; far less than any sequence consisting of 12 amino acid sequence motifs consisting of the amino acids G, S, T, E, P, analyzed in the present Example.

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. In contrast, polypeptides created from amino acids limited to A, S and P that have a higher degree of internal repetitiveness are predicted to have a high percentage of alpha-helices, as determined by the Chou-Fasman algorithm, as well as random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) greater than about 400 amino acid residues in length are expected to have very limited secondary structure. With the exception of motifs containing three contiguous serines, it is believed that any order or combination of sequence motifs from Table 1 can be used to create an XTEN polypeptide of a length greater than about 400 residues that will result in an XTEN sequence that is substantially devoid of secondary structure. Such sequences are expected to have the characteristics described in the GHXTEN embodiments of the invention disclosed herein.

TABLE 27

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GSTSESPSGTAP | 624 | 12 | Residue totals*: H: 0 E: 0 percent: H: 0.0 E: 0.0 | Not Determined |
| | GTS TPESGSASP | 625 | 12 | Residue totals: H: 0 E: 0 percent: H: 0.0 E: 0.0 | Not Determined |
| | GTSPSGESSTAP | 626 | 12 | Residue totals: H: 0 E: 0 percent: H: 0.0 E: 0.0 | Not Determined |
| | GSTSSTAESPGP | 627 | 12 | Residue totals: H: 0 E: 0 percent: H: 0.0 E: 0.0 | Not Determined |
| | GSPAGSPTSTEEGTSESATPES GP | 628 | 24 | Residue totals: H: 0 E: 0 percent: H: 0.0 E: 0.0 | 91.67% |
| | GSPAGSPTSTEEGTSESATPES GPGTSTEPSEGSAP | 629 | 36 | Residue totals: H: 0 E: 0 percent: H: 0.0 E: 0.0 | 94.44% |
| | GSPAGSPTSTEEGTSESATPES GPGTSTEPSEGSAPGSPAGSPT STEE | 630 | 48 | Residue totals: H: 0 E: 0 percent: H: 0.0 E: 0.0 | 93.75% |
| | GSPAGSPTSTEEGTSESATPES GPGTSTEPSEGSAPGSPAGSPT STEEGTSTEPSEGSAP | 631 | 60 | Residue totals: H: 0 E: 0 percent: H: 0.0 E: 0.0 | 96.67% |
| | GSPAGSPTSTEEGTSESATPES GPGTSTEPSEGSAPGSPAGSPT STEEGTSTEPSEGSAPGTSTEP SEGSAPGTSESATPESGPGSEP ATSGSE TPGSEPATSGSETP | 632 | 108 | Residue totals: H: 0 E: 0 percent: H: 0.0 E: 0.0 | 97.22% |
| | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAP | 633 | 216 | Residue totals: H: 0 E: 0 percent: H: 0.0 E: 0.0 | 99.07% |
| | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE SATPESGPGSEPATSGSETPGT STEPSEGSAPGTSTEPSEGSAP GTSESATPESGPGTSESATPES GPGSPAGSPTSTEEGTSESATP ESGPGSEPATSGSETPGTSESA TPESGPGTSTEPSEGSAPGTST EPSEGSAPGTSTEPSEGSAPGT STEPSEGSAPGTSTEPSEGSAP GTSTEPSEGSAPGSPAGSPTST EEGTSTEPSEGSAP | 634 | 432 | Residue totals: H: 2 E: 3 percent: H: 0.5 E: 0.7 | 99.54% |
| AE864 | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE SATPESGPGSEPATSGSETPGT | 635 | 864 | Residue totals: H: 2 E: 3 percent: H: 0.2 E: 0.3 | 99.77% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | STEPSEGSAPGTSTEPSEGSAP GTSESATPESGPGTSESATPES GPGSPAGSPTSTEEGTSESATP ESGPGSEPATSGSETPGTSESA TPESGPGTSTEPSEGSAPGTST EPSEGSAPGTSTEPSEGSAPGT STEPSEGSAPGTSTEPSEGSAP GTSTEPSEGSAPGSPAGSPTST EEGTSTEPSEGSAPGTSESATP ESGPGSEPATSGSETPGTSESA TPESGPGSEPATSGSETPGTSE SATPESGPGTSTEPSEGSAPGT SESATPESGPGSPAGSPTSTEE GSPAGSPTSTEEGSPAGSPTST EEGTSESATPESGPGTSTEPSE GSAPGTSESATPESGPGSEPAT SGSETPGTSESATPESGPGSEP ATSGSETPGTSESATPESGPGT STEPSEGSAPGSPAGSPTSTEE GTSESATPESGPGSEPATSGSE TPGTSESATPESGPGSPAGSPT STEEGSPAGSPTSTEEGTSTEP SEGSAPGTSESATPESGPGTSE SATPESGPGTSESATPESGPGS EPATSGSETPGSEPATSGSETP GSPAGSPTSTEEGTSTEPSEGS APGTSTEPSEGSAPGSEPATSG SETPGTSESATPESGPGTSTEP SEGSAP | | | | |
| AD576 | GSSESGSSEGGPGSGGEPSESG SSGSSESGSSEGGPGSSESGSS EGGPGSSESGSSEGGPGSSESG SSEGGPGSSESGSSEGGPGESP GGSSGSESGSEGSSGPGESSGS SESGSSEGGPGSSESGSSEGGP GSSESGSSEGGPGSGGEPSESG SSGESPGGSSGSESGESPGGSS GSESGSGGEPSESGSSGSSESG SSEGGPGSGGEPSESGSSGSGG EPSESGSSGSEGSSGPGESSGE SPGGSSGSESGSGGEPSESGSS GSGGEPSESGSSGSGGEPSESG SSGSSESGSSEGGPGESPGGSS GSESGESPGGSSGSESGESPGG SSGSESGESPGGSSGSESGESP GGSSGSESGSSESGSSEGGPGS GGEPSESGSSGSEGSSGPGESS GSSESGSSEGGPGSGGEPSESG SSGSSESGSSEGGPGSGGEPSE SGSSGESPGGSSGSESGESPGG SSGSESGSSESGSSEGGPGSGG EPSESGSSGSSESGSSEGGPGS GGEPSESGSSGSGGEPSESGSS GESPGGSSGSESGSEGSSGPGE SSGSSESGSSEGGPGSEGSSGP GESS | 636 | 576 | Residue totals: H: 7 E: 0 percent: H: 1.2 E: 0.0 | 99.65% |
| AE576 | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE SATPESGPGSEPATSGSETPGT STEPSEGSAPGTSTEPSEGSAP GTSESATPESGPGTSESATPES GPGSPAGSPTSTEEGTSESATP ESGPGSEPATSGSETPGTSESA TPESGPGTSTEPSEGSAPGTST EPSEGSAPGTSTEPSEGSAPGT | 637 | 576 | Residue totals: H: 2 E: 0 percent: H: 0.4 E: 0.0 | 99.65% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | STEPSEGSAPGTSTEPSEGSAP GTSTEPSEGSAPGSPAGSPTST EEGTSTEPSEGSAPGTSESATP ESGPGSEPATSGSETPGTSESA TPESGPGSEPATSGSETPGTSE SATPESGPGTSTEPSEGSAPGT SESATPESGPGSPAGSPTSTEE GSPAGSPTSTEEGSPAGSPTST E7EGTSESATPESGPGTSTEPS EGSAP | | | | |
| AF540 | GSTSSTAESPGPGSTSSTAESP GPGSTSESPSGTAPGSTSSTAE SPGPGSTSSTAESPGPGTSTPE SGSASPGSTSESPSGTAPGTSP SGESSTAPGSTSESPSGTAPGS TSESPSGTAPGTSPSGESSTAP GSTSESPSGTAPGSTSESPSGT APGTSPSGESSTAPGSTSESPS GTAPGSTSESPSGTAPGSTSES PSGTAPGTSTPESGSASPGSTS ESPSGTAPGTSTPESGSASPGS TSSTAESPGPGSTSSTAESPGP GTSTPESGSASPGTSTPESGSA SPGSTSESPSGTAPGTSTPESG SASPGTSTPESGSASPGSTSESP SGTAPGSTSESPSGTAPGSTSE SPSGTAPGSTSSTAESPGPGTS TPESGSASPGTSTPESGSASPG STSESPSGTAPGSTSESPSGTA PGTSTPESGSASPGSTSESPSG TAPGSTSESPSGTAPGTSTPES GSASPGTSPSGESSTAPGSTSS TAESPGPGTSPSGESSTAPGST SSTAESPGPGTSTPESGSASPG STSESPSGTAP | 638 | 540 | Residue totals: H: 2 E: 0 percent: H: 0.4 E: 0.0 | 99.65 |
| AF504 | GASPGTSSTGSPGSSPSASTGT GPGSSPSASTGTGPGTPGSGT ASSSPGSSTPSGATGSPGSNPS ASTGTGPGASPGTSSTGSPGTP GSGTASSSPGSSTPSGATGSPG TPGSGTASSSPGASPGTSSTGS PGASPGTSSTGSPGTPGSGTAS SSPGSSTPSGATGSPGASPGTS STGSPGTPGSGTASSSPGSSTP SGATGSPGSNPSASTGTGPGSS PSASTGTGPGSSTPSGATGSPG SSTPSGATGSPGASPGTSSTGS PGASPGTSSTGSPGASPGTSST GSPGTPGSGTASSSPGASPGTS STGSPGASPGTSSTGSPGASPG TSSTGSPGSSPSASTGTGPGTP GSGTASSSPGASPGTSSTGSPG ASPGTSSTGSPGASPGTSSTGS PGSSTPSGATGSPGSSTPSGAT GSPGASPGTSSTGSPGTPGSGT ASSSPGSSTPSGATGSPGSSTP SGATGSPGSSTPSGATGSPGSS PSASTGTGPGASPGTSSTGSP | 639 | 504 | Residue totals: H: 0 E: 0 percent: H: 0.0 E: 0.0 | 94.44% |
| AE864 | GSPAGSPTSTEEGTSESATPES GPGTSTEPSEGSAPGSPAGSPT STEEGTSTEPSEGSAPGTSTEP SEGSAPGTSESATPESGPGSEP ATSGSETPGSEPATSGSETPGS PAGSPTSTEEGTSESATPESGP GTSTEPSEGSAPGTSTEPSEGS APGSPAGSPTSTEEGTSTEPSE GSAPGTSTEPSEGSAPGTSESA TPESGPGTSTEPSEGSAPGTSE SATPESGPGSEPATSGSETPGT STEPSEGSAPGTSTEPSEGSAP GTSESATPESGPGTSESATPES GPGSPAGSPTSTEEGTSESATP | 640 | 864 | Residue totals: H: 2 E: 3 percent: H: 0.2 E: 0.4 | 99.77% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | ESGPGSEPATSGSETPGTSESA<br>TPESGPGTSTEPSEGSAPGTST<br>EPSEGSAPGTSTEPSEGSAPGT<br>STEPSEGSAPGTSTEPSEGSAP<br>GTSTEPSEGSAPGSPAGSPTST<br>EEGTSTEPSEGSAPGTSESATP<br>ESGPGSEPATSGSETPGTSESA<br>TPESGPGSEPATSGSETPGTSE<br>SATPESGPGTSTEPSEGSAPGT<br>SESATPESGPGSPAGSPTSTEE<br>GSPAGSPTSTEEGSPAGSPTST<br>EEGTSESATPESGPGTSTEPSE<br>GSAPGTSESATPESGPGSEPAT<br>SGSETPGTSESATPESGPGSEP<br>ATSGSETPGTSESATPESGPGT<br>STEPSEGSAPGSPAGSPTSTEE<br>GTSESATPESGPGSEPATSGSE<br>TPGTSESATPESGPGSPAGSPT<br>STEEGSPAGSPTSTEEGTSTEP<br>SEGSAPGTSESATPESGPGTSE<br>SATPESGPGTSESATPESGPGS<br>EPATSGSETPGSEPATSGSETP<br>GSPAGSPTSTEEGTSTEPSEGS<br>APGTSTEPSEGSAPGSEPATSG<br>SETPGTSESATPESGPGTSTEP<br>SEGSAP | | | | |
| AF864 | GSTSESPSGTAPGTSPSGESST<br>APGSTSESPSGTAPGSTSESPS<br>GTAPGTSTPESGSASPGTSTPE<br>SGSASPGSTSESPSGTAPGSTS<br>ESPSGTAPGTSPSGESSTAPGS<br>TSESPSGTAPGTSPSGESSTAP<br>GTSPSGESSTAPGSTSSTAESP<br>GPGTSPSGESSTAPGTSPSGES<br>STAPGSTSSTAESPGPGTSTPE<br>SGSASPGTSTPESGSASPGSTS<br>ESPSGTAPGSTSESPSGTAPGT<br>STPESGSASPGSTSSTAESPGP<br>GTSTPESGSASPGSTSESPSGT<br>APGTSPSGESSTAPGSTSSTAE<br>SPGPGTSPSGESSTAPGTSTPE<br>SGSASPGSTSSTAESPGPGSTS<br>STAESPGPGSTSSTAESPGPGS<br>TSSTAESPGPGTSPSGESSTAP<br>GSTSESPSGTAPGSTSESPSGT<br>APGTSTPESGPXXXGASASGA<br>PSTXXXXSESPSGTAPGSTSES<br>PSGTAPGSTSESPSGTAPGSTS<br>ESPSGTAPGSTSESPSGTAPGS<br>TSESPSGTAPGTSTPESGSASP<br>GTSPSGESSTAPGTSPSGESST<br>APGSTSSTAESPGPGTSPSGES<br>STAPGTSTPESGSASPGSTSES<br>PSGTAPGSTSESPSGTAPGTSP<br>SGESSTAPGSTSESPSGTAPGT<br>STPESGSASPGTSTPESGSASP<br>GSTSESPSGTAPGTSTPESGSA<br>SPGSTSSTAESPGPGSTSESPSG<br>TAPGSTSESPSGTAPGTSPSGE<br>SSTAPGSTSSTAESPGPGTSPS<br>GESSTAPGTSTPESGSASPGTS<br>PSGESSTAPGTSPSGESSTAPG<br>TSPSGESSTAPGTSSTAESPG<br>PGSTSSTAESPGPGTSPSGESS<br>TAPGSSPSASTGTGPGSSTPSG<br>ATGSPGSSTPSGATGSP | 641 | 875 | Residue totals: H: 2 E: 0<br>percent: H: 0.2 E: 0.0 | 95.20% |
| AG864 | GGSPGASPGTSSTGSPGSSPSA<br>STGTGPGSSPSASTGTGPGTPG<br>SGTASSSPGSSTPSGATGSPGS<br>NPSASTGTGPGASPGTSSTGSP<br>GTPGSGTASSSPGSSTPSGATG<br>SPGTPGSGTASSSPGASPGTSS<br>TGSPGASPGTSSTGSPGTPGSG | 642 | 868 | Residue totals: H: 0 E: 0<br>percent: H: 0.0 E: 0.0 | 94.70% |

195 196

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TASSSPGSSTPSGATGSPGASP GTSSTGSPGTPGSGTASSSPGS STPSGATGSPGSNPSASTGTGP GSSPSASTGT7GPGSSTPSGAT GSPGSSTPSGATGSPGASPGTS STGSPGASPGTSSTGSPGASPG TSSTGSPGTPGSGTASSSPGAS PGTSSTGSPGASPGTSSTGSPG ASPGTSSTGSPGSSPSASTGTG PGTPGSGTASSSPGASPGTSST GSPGASPGTSSTGSPGASPGTS STGSPGSSTPSGATGSPGSSTP SGATGSPGASPGTSSTGSPGTP GSGTASSSPGSSTPSGATGSPG SSTPSGATGSPGSSTPSGATGS PGSSPSASTGTGPGASPGTSST GSPGASPGTSSTGSPGTPGSGT ASSSPGASPGTSSTGSPGASPG TSSTGSPGASPGTSSTGSPGAS PGTSSTGSPGTPGSGTASSSPG SSTPSGATGSPGTPGSGTASSS PGSSTPSGATGSPGTPGSGTAS SSPGSSTPSGATGSPGSSTPSG ATGSPGSSPSASTGTGPGSSPS ASTGTGPGASPGTSSTGSPGTP GSGTASSSPGSSTPSGATGSPG SSPSASTGTGPGSSPSASTGTG PGASPGTSSTGSPGASPGTSST GSPGSSTPSGATGSPGSSPSAS TGTGPGASPGTSSTGSPGSSPS ASTGTGPGTPGSGTASSSPGSS TPSGATGSPGSSTPSGATGSPG ASPGTSSTGSP | | | | |
| AM875 | GTSTEPSEGSAPGSEPATSGSE TPGSPAGSPTSTEEGSTSSTAE SPGPGTSTPESGSASPGSTSESP SGTAPGSTSESPSGTAPGTSTP ESGSASPGTSTPESGSASPGSE PATSGSETPGTSESATPESGPG SPAGSPTSTEEGTSTEPSEGSA PGTSESATPESGPGTSTEPSEG SAPGTSTEPSEGSAPGSPAGSP TSTEEGTSTEPSEGSAPGTSTE PSEGSAPGTSESATPESGPGTS ESATPESGPGTSTEPSEGSAPG TSTEPSEGSAPGTSESATPESG PGTSTEPSEGSAPGSEPATSGS ETPGSPAGSPTSTEEGSSTPSG ATGSPGTPGSGTASSSPGSSTP SGATGSPGTSTEPSEGSAPGTS TEPSEGSAPGSEPATSGSETPG SPAGSPTSTEEGSPAGSPTSTE EGTSTEPSEGSAPGASASGAPS TGGTSESATPESGPGSPAGSPT STEEGSPAGSPTSTEEGSTSST AESPGPGSTSESPSGTAPGTSP SGESSTAPGTPGSGTASSSPGS STPSGATGSPGSSPSASTGTGP GSEPATSGSETPGTSESATPES GPGSEPATSGSETPGSTSSTAE SPGPGSTSSTAESPGPGTSPSG ESSTAPGSEPATSGSETPGSEP ATSGSETPGTSTEPSEGSAPGS TSSTAESPGPGTSTPESGSASP GSTSESPSGTAPGTSTEPSEGS APGTSTEPSEGSAPGTSTEPSE GSAPGSSTPSGATGSPGSSPSA STGTGPGASPGTSSTGSPGSEP ATSGSETPGTSESATPESGPGS PAGSPTSTEEGSSTPSGATGSP GSSPSASTGTGPGASPGTSSTG SPGTSESATPESGPGTSTEPSE GSAPGTSTEPSEGSAP | 643 | 875 | Residue totals: H: 7 E: 3 percent: H: 0.8 E: 0.3 | 98.63% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AM1318 | GTSTEPSEGSAPGSEPATSGSE TPGSPAGSPTSTEEGSTSSTAE SPGPGTSTPESGSASPGSTSESP SGTAPGSTSESPSGTAPGTSTP ESGSASPGTSTPESGSASPGSE PATSGSETPGTSESATPESGPG SPAGSPTSTEEGTSTEPSEGSA PGTSESATPESGPGTSTEPSEG SAPGTSTEPSEGSAPGSPAGSP TSTEEGTSTEPSEGSAPGTSTE PSEGSAPGTSESATPESGPGTS ESATPESGPGTSTEPSEGSAPG TSTEPSEGSAPGTSESATPESG PGTSTEPSEGSAPGSEPATSGS ETPGSPAGSPTSTEEGSSTPSG ATGSPGTPGSGTASSSPGSSTP SGATGSPGTSTEPSEGSAPGTS TEPSEGSAPGSEPATSGSETPG SPAGSPTSTEEGSPAGSPTSTE EGTSTEPSEGSAPGPEPTGPAP SGGSEPATSGSETPGTSESATP ESGPGSPAGSPTSTEEGTSESA TPESGPGSPAGSPTSTEEGSPA GSPTSTEEGTSESATPESGPGS PAGSPTSTEEGSPAGSPTSTEE GSTSSTAESPGPGSTSESPSGT APGTSPSGESSTAPGSTSESPS GTAPGSTSESPSGTAPGTSPSG ESSTAPGTSTEPSEGSAPGTSE SATPESGPGTSESATPESGPGS EPATSGSETPGTSESATPESGP GTSESATPESGPGTSTEPSEGS APGTSESATPESGPGTSTEPSE GSAPGTSPSGESSTAPGTSPSG ESSTAPGTSPSGESSTAPGTST EPSEGSAPGSPAGSPTSTEEGT STEPSEGSAPGSSPSASTGTGP GSSTPSGATGSPGSSTPSGATG SPGSSTPSGATGSPGSSTPSGA TGSPGASPGTSSTGSPGASASG APSTGGTSPSGESSTAPGSTSS TAESPGPGTSPSGESSTAPGTS ESATPESGPGTSTEPSEGSAPG TSTEPSEGSAPGSSPSASTGTG PGSSTPSGATGSPGASPGTSST GSPGTSTPESGSASPGTSPSGE SSTAPGTSPSGESSTAPGTSES ATPESGPGSEPATSGSETPGTS TEPSEGSAPGSTSESPSGTAPG STSESPSGTAPGTSTPESGSAS PGSPAGSPTSTEEGTSESATPE SGPGTSTEPSEGSAPGSPAGSP TSTEEGTSESATPESGPGSEPA TSGSETPGSSTPSGATGSPGAS PGTSSTGSPGSSTPSGATGSPG STSESPSGTAPGTSPSGESSTA PGSTSSTAESPGPGSSTPSGAT GSPGASPGTSSTGSPGTPGSGT ASSSPGSPAGSPTSTEEGSPAG SPTSTEEGTSTEPSEGSAP | 644 | 1318 | Residue totals: H: 7 E: 0 percent: H: 0.7 E: 0.0 | 99.17% |
| AM923 | MAEPAGSPTSTEEGASPGTSS TGSPGSSTPSGATGSPGSSTPS GATGSPGTSTEPSEGSAPGSEP ATSGSETPGSPAGSPTSTEEGS TSSTAESPGPGTSTPESGSASP GSTSESPSGTAPGSTSESPSGT APGTSTPESGSASPGTSTPESG SASPGSEPATSGSETPGTSESA TPESGPGSPAGSPTSTEEGTST EPSEGSAPGTSESATPESGPGT STEPSEGSAPGTSTEPSEGSAP GSPAGSPTSTEEGTSTEPSEGS APGTSTEPSEGSAPGTSESATP ESGPGTSESATPESGPGTSTEP | 645 | 924 | Residue totals: H: 4 E: 3 percent: H: 0.4 E: 0.3 | 98.70% |

TABLE 27-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | SEGSAPGTSTEPSEGSAPGTSE SATPESGPGTSTEPSEGSAPGS EPATSGSETPGSPAGSPTSTEE GSSTPSGATGSPGTPGSGTASS SPGSSTPSGATGSPGTSTEPSE GSAPGTSTEPSEGSAPGSEPAT SGSETPGSPAGSPTSTEEGSPA GSPTSTEEGTSTEPSEGSAPGA SASGAPSTGGTSESATPESGPG SPAGSPTSTEEGSPAGSPTSTE EGSTSSTAESPGPGSTSESPSG TAPGTSPSGESSTAPGTPGSGT ASSSPGSSTPSGATGSPGSSPS ASTGTGPGSEPATSGSETPGTS ESATPESGPGSEPATSGSETPG STSSTAESPGPGSTSSTAESPG PGTSPSGESSTAPGSEPATSGS ETPGSEPATSGSETPGTSTEPS EGSAPGSTSSTAESPGPGTSTP ESGSASPGSTSESPSGTAPGTS TEPSEGSAPGTSTEPSEGSAPG TSTEPSEGSAPGSSTPSGATGS PGSSPSASTGTGPGASPGTSST GSPGSEPATSGSETPGTSESAT PESGPGSPAGSPTSTEEGSSTP SGATGSPGSSPSASTGTGPGAS PGTSSTGSPGTSESATPESGPG TSTEPSEGSAPGTSTEPSEGSAP | | | | |
| AE912 | MAEPAGSPTSTEEGTPGSGTA SSSPGSSTPSGATGSPGASPGT SSTGSPGSPAGSPTSTEEGTSE SATPESGPGTSTEPSEGSAPGS PAGSPTSTEEGTSTEPSEGSAP GTSTEPSEGSAPGTSESATPES GPGSEPATSGSETPGSEPATSG SETPGSPAGSPTSTEEGTSESA TPESGPGTSTEPSEGSAPGTST EPSEGSAPGSPAGSPTSTEEGT STEPSEGSAPGTSTEPSEGSAP GTSESATPESGPGTSTEPSEGS APGTSESATPESGPGSEPATSG SETPGTSTEPSEGSAPGTSTEP SEGSAPGTSESATPESGPGTSE SATPESGPGSPAGSPTSTEEGT SESATPESGPGSEPATSGSETP GTSESATPESGPGTSTEPSEGS APGTSTEPSEGSAPGTSTEPSE GSAPGTSTEPSEGSAPGTSTEP SEGSAPGTSTEPSEGSAPGSPA GSPTSTEEGTSTEPSEGSAPGT SESATPESGPGSEPATSGSETP GTSESATPESGPGSEPATSGSE TPGTSESATPESGPGTSTEPSE GSAPGTSESATPESGPGSPAGS PTSTEEGSPAGSPTSTEEGSPA GSPTSTEEGTSESATPESGPGT STEPSEGSAPGTSESATPESGP GSEPATSGSETPGTSESATPES GPGSEPATSGSETPGTSESATP ESGPGTSTEPSEGSAPGSPAGS PTSTEEGTSESATPESGPGSEP ATSGSETPGTSESATPESGPGS PAGSPTSTEEGSPAGSPTSTEE GTSTEPSEGSAPGTSESATPES GPGTSESATPESGPGTSESATP ESGPGSEPATSGSETPGSEPAT SGSETPGSPAGSPTSTEEGTST EPSEGSAPGTSTEPSEGSAPGS EPATSGSETPGTSESATPESGP GTSTEPSEGSAP | 646 | 913 | Residue totals: H: 8 E: 3 percent: H: 0.9 E: 0.3 | 99.45% |
| BC864 | GTSTEPSEPGSAGTSTEPSEPG SAGSEPATSGTEPSGSGASEPT STEPGSEPATSGTEPSGSEPAT | 647 | | Residue totals: H: 0 E: 0 percent: H: 0 E: 0 | 99.77% |

TABLE 27-continued

CHOU-FASMAN and GOR prediction calculations of polypeptide sequences

| SEQ NAME | Sequence | SEQ ID NO: | Residues | Chou-Fasman Calculation | GOR Calculation |
|---|---|---|---|---|---|
| | SGTEPSGSEPATSGTEPSGSGA | | | | |
| | SEPTSTEPGTSTEPSEPGSAGS | | | | |
| | EPATSGTEPSGTSTEPSEPGSA | | | | |
| | GSEPATSGTEPSGSEPATSGTE | | | | |
| | PSGTSTEPSEPGSAGTSTEPSEP | | | | |
| | GSAGSEPATSGTEPSGSEPATS | | | | |
| | GTEPSGTSEPSTSEPGAGSGAS | | | | |
| | EPTSTEPGTSEPSTSEPGAGSE | | | | |
| | PATSGTEPSGSEPATSGTEPSG | | | | |
| | TSTEPSEPGSAGTSTEPSEPGS | | | | |
| | AGSGASEPTSTEPGSEPATSGT | | | | |
| | EPSGSEPATSGTEPSGSEPATS | | | | |
| | GTEPSGSEPATSGTEPSGTSTE | | | | |
| | PSEPGSAGSEPATSGTEPSGSG | | | | |
| | ASEPTSTEPGTSTEPSEPGSAG | | | | |
| | SEPATSGTEPSGSGASEPTSTE | | | | |
| | PGTSTEPSEPGSAGSGASEPTS | | | | |
| | TEPGSEPATSGTEPSGSGASEP | | | | |
| | TSTEPGSEPATSGTEPSGSGAS | | | | |
| | EPTSTEPGTSTEPSEPGSAGSE | | | | |
| | PATSGTEPSGSGASEPTSTEPG | | | | |
| | TSTEPSEPGSAGSEPATSGTEP | | | | |
| | SGTSTEPSEPGSAGSEPATSGT | | | | |
| | EPSGTSTEPSEPGSAGTSTEPS | | | | |
| | EPGSAGTSTEPSEPGSAGTSTE | | | | |
| | PSEPGSAGTSTEPSEPGSAGTS | | | | |
| | TEPSEPGSAGTSEPSTSEPGAG | | | | |
| | SGASEPTSTEPGTSTEPSEPGS | | | | |
| | AGTSTEPSEPGSAGTSTEPSEP | | | | |
| | GSAGSEPATSGTEPSGSGASEP | | | | |
| | TSTEPGSEPATSGTEPSGSEPA | | | | |
| | TSGTEPSGSEPATSGTEPSGSE | | | | |
| | PATSGTEPSGTSEPSTSEPGAG | | | | |
| | SEPATSGTEPSGSGASEPTSTE | | | | |
| | PGTSTEPSEPGSAGSEPATSGT | | | | |
| | EPSGSGASEPTSTEPGTSTEPS | | | | |
| | EPGSA | | | | |
| | ASPAAPAPASPAAPAPSAPAA APASPAPAAPSAPAPAAPSAA SPAAPSAPPAAASPAAPSAPPA ASAAAPAAASAAASAPSAAA | 648 | 84 | Residue totals: H: 58 E: 0 percent: H: 69.0 E: 0.0 | 78.57% |

*H: alpha-helix E: beta-sheet

Example 44

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 28, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 649), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 28

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGG EGGSGGEGGSGGEGGSGGEGGSGGEGGSGGEGGSGGEGGSGGEGGSGGEG GSGGEGGSGGEGGSGGEGGSGGEGGSGGEGGSGGEGGSGGEGGSGGEGGS GGEGGSGGEGGSGGEGGSGGEGGSGGEGGSGGEGGSGGEGGSGGEGGSGG EGGSGGEGGSGGEGGSGGEGGSGGEGGSGGEGGSGGEG | 650 | 33.3 |
| K288 | GEGEGGGEGGEGEGGGEGGEGEGGGEGGEGEGGGEGGEGEGGGEGGEGE GGGEGGEGEGGGEGGEGEGGGEGGEGEGGGEGGEGEGGGEGGEGEGGGE GGEGEGGGEGGEGEGGGEGGEGEGGGEGGEGEGGGEGGEGEGGGEGGEG EGGGEGGEGEGGGEGGEGEGGGEGGEGEGGGEGGEGEGGGEGGEGEGGG EGGEGEGGGEGGEGEGGGEGGEGEGGGEGGEGEGGGEGGEGEGGGEGGE GEGGGEGGEGEGGGEGGEGEGGGEGGEGEGGGEGGEGEGGGEG | 651 | 46.9 |
| L288 | SSESSSESSSSESSSESSSESSSSESSSESSSESSSSESSSESSSSESSSESSSSE SSSSESSSSESSSSESSSSESSSSESSSSESSSSESSSSESSSSESSSSESSSS ESSSESSSESSSSESSSESSSSESSSESSSSESSSESSSSESSSSESSSESSSS SESSSESSSSESSSESSSSESSSESSSSESSSSESSSSESSSESSSSESSSESSS SSESSSESSSESSSSESSSESSSESSSSESSSESSSESSSSES | 652 | 50.0 |
| Y288 | GEGSGEGSEGEGSEGSGEGEGSEGSGEGEGGSEGSEGEGGSEGSEGEGGSEG SEGEGSGEGSEGEGGSEGSEGEGSGEGSEGSEGEGSEGSEGEGGSEGSEGSG EGSEGEGGSEGSEGEGSGEGSEGEGSEGSGEGEGGSEGSGEGEGSEGSEGEG SEGSGEGEGSEGSGEGEGGSEGSEGEGSEGSGEGEGGSEGSGEGEGSGEGSEG EGGGEGSEGEGSGEGGEGSEGGSEGEGSEGGEGEGSEGSEGEGEGSEGGS EGEGSEGGSEGEGSEGSGEGEGSEGSGE | 653 | 26.8 |
| Q576 | GGKPGEGGKPEGGGGKPGGKPEGEGEGKPGGKPEGGGKPGGGEGGKPEGG KPEGEGKPGGGEGKPGGKPEGGGGKPEGEGKPGGGGGKPGGKPEGEGKPG GGEGGKPEGKPGEGGGEGKPGGKPEGGGGEGKPGGGKPGEGGKPGEGKPGGG EGGKPEGGKPEGEGKPGGGEGKPGGKPGEGGKPEGGGEGKPGGKPGEGGE GKPGGGKPEGEGKPGGGKPGGGEGGKPEGEGKPGGKPEGGGEGKPGGKPE GGGKPEGGGEGKPGGGKPGEGGKPGEGEGKPGGKPEGEGKPGGEGGGKPE GKPGGGEGGKPEGGKPGEGGKPEGGKPGEGGEGKPGGGKPGEGGKPEGGG KPEGEGKPGGGGKPGEGGKPEGGKPEGGGEGKPGGGKPEGEGKPGGGEGK PGGKPEGGGGKPGEGGKPEGGKPGGEGGGKPEGEGKPGGKPGEGGGGKPG GKPEGEGKPGEGGEGKPGGKPEGGGEGKPGGKPEGGGEGKPGGKPGEGG KPEGGGKPGEGGKPGEGGKPEGEGKPGGGEGKPGGKPGEGGKPEGGGEGK PGGKPGGEGGGKPEGGKPGEGGKPEG | 654 | 18.5 |
| U576 | GEGKPGGKPGSGGGKPGEGGKPGSGEGKPGGKPGSGGSGKPGGKPGEGGK PEGGSGGKPGGGGKPGGKPGGEGSGKPGGKPEGGGKPEGGSGGKPGGKPE GGSGGKPGGKPGSGEGGKPGGGKPGGEGKPGSGKPGGEGSGKPGGKPEGG SGGKPGGKPEGGSGGKPGGSGKPGGKPGEGGKPEGGSGGKPGGSGKPGGK PEGGSGKPGGKPGEGGKPGGGKPGGEGKPGSGKPGGEGSGKP GGKPGSGGEGKPGGKPEGGSGGKPGGGKPGGEGKPGSGKPGEGGKPGSG GGKPGGKPGGEGEGKPGGKPGEGGKPGGEGSGKPGGGGKPGGKPGGEGGK PEGSGKPGGGSGKPGGKPEGGGKPEGSGKPGGGGKPEGSGKPGGGKPEGG SGGKPGGSGKPGGKPGEGGGKPEGSGKPGGGSGKPGGKPEGGGKPEGGSG GKPGGKPEGGSGGKPGGKPGGEGSGKPGGKPGSGEGGKPGGKPGEGSGGK PGGKPEGGSGGKPGGSGKPGGKPEGGGSGKPGGKPGEGGKPGGEGSGKPG GSGKPG | 655 | 18.1 |
| W576 | GGSGKPGKPGGSGSGKPGSGKPGGGSGKPGSGKPGGGSGKPGSGKPGGGSG KPGSGKPGGGGKPGSGSGKPGGGKPGGSGGKPGGGSGKPGKPGSGGSGKP GSGKPGGGSGGKPGKPGSGGSGGKPGKPGSGGGSGKPGKPGSGGSGGKPG KPGSGGSGGKPGKPGSGGSGKPGSGKPGGGSGKPGSGKPGSGGSGKPGKPG SGGSGKPGSGKPGSGKPGGGSGKPGSGKPGGSGGKPGKPGSGG GKPGSGSGKPGGGKPGSGSGKPGGGKPGGSGKPGGSGGKPGKPGSGGGS GKPGKPGSGGGSGKPGKPGGSGSGKPGSGKPGGGSGKPGSGKPGSGGSGKP GKPGSGGSGKPGKPGSGGGKPGSGSGKPGGGKPGGGSGKPGKPGSGGGSGG KPGGGKPGSGSGKPGGSGKPGSGKPGGGSGGKPGKPGSGGGSGKPGSGKPGS GGSGKPGKPGGGSGKPGSGKPGGGSGGKPGSGKPGGGSGKPGSGKPGGGSG KPGSGKPGGGGKPGSGSGKPGGGGKPGKPGSGGSGGKPGKPGSGGSGKPG SGKPGGGSGGKPGKPGSGG | 656 | 23.4 |
| Y576 | GEGSGEGSEGEGSEGSGEGEGSEGSGEGEGGSEGSEGEGSEGSGEGEGGEGS GEGEGSGEGSEGEGGSEGSEGEGGSGEGEGSGEGGSEGSEGEGGSEGEGEGS EGSGEGEGSEGGSEGEGSEGSGEGSEGSGEGSEGSGEGEGSEGSGEGE | 657 | 15.7 |

TABLE 28-continued

Subsequence score calculations of polypeptide sequences

| Seq Name | Amino Acid Sequence | SEQ ID NO: | Score |
|---|---|---|---|
| | GSEGSGEGEGSEGGSEGEGGSEGSEGEGSGEGSEGEGGSEGSEGEGGGEGSE GEGSGEGSEGEGGSEGSEGEGGSEGSEGEGGEGSGEGEGSGSGEGEGEG SEGEGSEGSGEGEGSEGSGEGEGSEGSEGEGSGEGSEGEGSEGSGEGEGSE GSGEGEGGSEGSEGEGGSEGSEGEGGSEGSEGEGGSEGSGEGEGSEGSGEGEG SGEGSEGEGSEGSGEGEGSEGSGEGEGGSEGSEGEGSEGSGEGEGGEGSGEG EGSGEGSEGEGGGEGSEGEGSEGSGEGEGSEGSGEGEGSEGGSEGEGGSEGS EGEGSEGGSEGEGSEGSGEGEGSEGSGEGEGSGEGSGEGEGSGEGEGGSE GGEGEGSEGGSEGEGSEGGGEGSGEGEGGGEGSEGEGSEGSGEGEGS GEGSE | | |
| AD576 | GSSESGSSEGGPGSGGEPSESGSSGSSESGSSEGGPGSSESGSSEGGPGSSESGS SEGGPGSSESGSSEGGPGSSESGSSEGGPGESPGGSSGSESGSEGSSGPGESSG SSESGSSEGGPGSSESGSSEGGPGSSESGSSEGGPGSGGEPSESGSSGESPGGSS GSESGESPGGSSGSESGSGGEPSESGSSGSSESGSSEGGPGSSGGEPSESGSSGS GGEPSESGSSGSEGSSGPGESSGESPGGSSGSESGSSGGEPSESGSSGSGGEPSES GSSSGSGGEPSESGSSGSSESGSSEGGPGESPGGSSGSESGESPGGSSGSESGESP GGSSGSESGESPGGSSGSESGESPGGSSGSESGSSESGSSEGGPGSGGEPSESG SSGSEGSSGPGESSGSSESGSSEGGPGSGGEPSESGSSGSSESGSSEGGPGSGG EPSESGSSGESPGGSSGSESGSPGSSGSESGSSESGSSEGGPGSGGEPSESGS SGSSESGSSEGGPGSGGEPSESGSSGSGGEPSESGSSGESPGGSSGSESGSEGSS GPGESSGSSESGSSEGGPGSEGSSGPGESS | 658 | 13.6 |
| AE576 | AGSPAGSPTSTEEGTSESATPESGPGTSTEPSEGSAPGSPAGSPTSTEEGTSTEP SEGSAPGTSTEPSEGSAPGTSESATPESGPGSEPATSGSETPGSEPATSGSETPG SPAGSPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSAPGTS ESATPESGPGSEPATSGSETPGTSTEPSEGSAPGTSTEPSEGSAPGTSESATPES GPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESAT PESGPGSEPATSGSETPGTSESATPESGPGSEPATSGSETPGTSESATPESGPGT STEPSEGSAPGTSESATPESGPGSPAGSPTSTEEGSPAGSPTSTEEGSPAGSPTS TEEGTSESATPESGPGTSTEPSEGSAP | 659 | 6.1 |
| AF540 | GSTSSTAESPGPGSTSSTAESPGPGSTSESPSGTAPGSTSSTAESPGPGSTSSTA ESPGPGTSTPESGSASPGSTSESPSGTAPGTSPSGESSTAPGSTSESPSGTAPGS TSESPSGTAPGTSPSGESSTAPGSTSESPSGTAPGSTSESPSGTAPGTSPSGESST APGSTSESPSGTAPGSTSESPSGTAPGSTSESPSGTAPGTSTPESGSASPGTSE SPSGTAPGTSTPESGSASPGSTSSTAESPGPGSTSSTAESPGPGTSTPESGSASP GTSTPESGSASPGSTSESPSGTAPGTSTPESGSASPGTSTPESGSASPGSTSESPS GTAPGSTSESPSGTAPGSTSESPSGTAPGSTSSTAESPGPGTSTPESGSASPGTS TPESGSASPGSTSESPSGTAPGTSTSESPSGTAPGTSTPESGSASPGTSESPSGT APGSTSESPSGTAPGTSTPESGSASPGTSPSGESSTAPGSTSSTAESPGPGTSPS GESSTAPGSTSSTAESPGPGTSTPESGSASPGTSESPSGTAP | 660 | 8.8 |
| AF504 | GASPGTSSTGSPGSSPSASTGTGPGSSPSASTGTGPGTPGSGTASSSPGSSTPSG ATGSPGSNPSASTGTGPGASPGTSSTGSPGTPGSGTASSSPGSSTPSGATGSPG TPGSGTASSSPGASPGTSSTGSPGASPGTSSTGSPGTPGSGTASSSPGSSTPSGA TGSPGASPGTSSTGSPGTPGSGTASSSPGSSTPSGATGSPGSNPSASTGTGPGS SPSASTGTGPGSSTPSGATGSPGSSTPSGATGSPGASPGTSSTGSPGASPGTSST GSPGASPGTSSTGSPGTPGSGTASSSPGASPGTSSTGSPGASPGTSSTGSPGAS PGTSSTGSPGSSPSASTGTGPGTPGSGTASSSPGASPGTSSTGSPGASPGTSSTG SPGASPGTSSTGSPGSSTPSGATGSPGSSTPSGATGSPGASPGTSSTGSPGTPGS GTASSSPGSSTPSGATGSPGSSTPSGATGSPGSSPSASTGTGP GASPGTSSTGSP | 661 | 7.0 |
| AE864 | GSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGS PAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSE SATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESA TPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATP ESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSES ATPESGPGSEPATSGSETPGTSESATPESGPGTSTEPSEGSAPGSPAGSPTSTEE GTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGS EPATSGSETPGSEPATSGSETPGSPAGSPTSTEEGTSTEPSEGSAP | 662 | 6.1 |
| AF864 | GSTSESPSGTAPGTSPSGESSTAPGSTSESPSGTAPGSTSESPSGTAPGTSTPES GSASPGTSTPESGSASPGSTSESPSGTAPGSTSESPSGTAPGTSPSGESSTAPGS | 663 | 7.5 |

TABLE 28-continued

Subsequence score calculations of polypeptide sequences

| Seq Name | Amino Acid Sequence | SEQ ID NO: | Score |
|---|---|---|---|
| | TSESPSGTAPGTSPSGESSTAPGTSPSGESSTAPGSTSSTAESPGPGTSPSGESST APGTSPSGESSTAPGSTSSTAESPGPGTSTPESGSASPGTSTPESGSASPGSTSE SPSGTAPGSTSESPSGTAPGTSTPESGSASPGSTSSTAESPGPGTSTPESGSASP GSTSESPSGTAPGTSPSGESSTAPGSTSSTAESPGPGTSPSGESSTAPGTSTPES GSASPGSTSSTAESPGPGSTSSTAESPGPGSTSSTAESPGPGSTSSTAESPGPGT SPSGESSTAPGSTSESPSGTAPGSTSESPSGTAPGTSTPESGPXXXGASASGAP STXXXXSESPSGTAPGSTSESPSGTAPGSTSESPSGTAPGSTSESPSGTAPGSTS ESPSGTAPGSTSESPSGTAPGTSTPESGSASPGTSPSGESSTAPGTSPSGESSTA PGSTSSTAESPGPGTSPSGESSTAPGTSTPESGSASPGTSESPSGTAPGSTSESP SGTAPGTSPSGESSTAPGSTSESPSGTAPGTSTPESGSASPGTSTPESGSASPGS TSESPSGTAPGTSTPESGSASPGSTSSTAESPGPGSTSESPSGTAPGSTSESPSGT APGTSPSGESSTAPGSTSSTAESPGPGTSPSGESSTAPGTSTPESGSASPGTSPS GESSTAPGTSPSGESSTAPGTSPSGESSTAPGSTSSTAESPGPGSTSSTAESPGP GTSPSGESSTAPGSSPSASTGTGPGSSTPSGATGSPGSSTPSGATGSP | | |
| AG868 | GGSPGASPGTSSTGSPGSSPSASTGTGPGSSPSASTGTGPGTPGSGTASSSPGS STPSGATGSPGSNPSASTGTGPGASPGTSSTGSPGTPGSGTASSSPGSSTPSGA TGSPGTPGSGTASSSPGASPGTSSTGSPGASPGTSSTGSPGTPGSGTASSSPGSS TPSGATGSPGASPGTSSTGSPGTPGSGTASSSPGSSTPSGATGSPGSNPSASTG TGPGSSPSASTGTGPGSSTPSGATGSPGSSTPSGATGSPGASPGTSSTGSPGAS PGTSSTGSPGASPGTSSTGSPGTPGSGTASSSPGASPGTSSTGSPGASPGTSSTG SPGASPGTSSTGSPGSSPSASTGTGPGTPGSGTASSSPGASPGTSSTGSPGASP GTSSTGSPGASPGTSSTGSPGSSTPSGATGSPGSSTPSGATGSPGASPGTSSTGS PGTPGSGTASSSPGSSTPSGATGSPGSSTPSGATGSPGSSPSA STGTGPGASPGTSSTGSPGASPGTSSTGSPGTPGSGTASSSPGASPGTSSTGSP GASPGTSSTGSPGASPGTSSTGSPGASPGTSSTGSPGTPGSGTASSSPGSSTPSG ATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSPG ASPGTSTGSPGSSTPSGATGSPGSSPSASTGTGPGASPGTSSTGSPGSSPSAST GTGPGTPGSGTASSSPGSSTPSGATGSPGSSTPSGATGSPGASPGTSSTGSP | 664 | 7.5 |
| AM875 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGASASG APSTGGTSESATPESGPGSPAGSPTSTEEGSPAGSPTSTEEGTSSTAESPGPGS TSESPSGTAPGTSPSGESSTAPGTPGSGTASSSPGSSTPSGATGSPGSSPSASTG TGPGSEPATSGSETPGTSESATPESGPGSEPATSGSETPGSTSSTAESPGPGSTS STAESPGPGTSPSGESSTAPGSEPATSGSETPGSEPATSGSETPGTSTEPSEGSA PGSTSSTAESPGPGTSTPESGSASPGSTSESPSGTAPGTSTEPSEGSAPGTSTEP SEGSAPGTSTEPSEGSAPGSSTPSGATGSPGSSPSASTGTGPGASPGTSSTGSP GSEPATSGSETPGTSESATPESGPGSPAGSPTSTEEGSSTPSGATGSPGSSPSAS TGTGPGASPGSSTGSPGTSESATPESGPGTSTEPSEGSAPGTSTEPSEGSAP | 665 | 4.5 |
| AM1318 | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSTPESGSASPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGPEPTGP APSGGSEPATSGSETPGTSESATPESGPGSPAGSPTSTEEGTSESATPESGPGSP AGSPTSTEEGSPAGSPTSTEEGTSESATPESGPGSPAGSPTSTEEGSPAGSPTST EEGSTSSTAESPGPGSTSESPSGTAPGTSPSGESSTAPGSTSESPSGTAPGSTSE SPSGTAPGTSPSGESSTAPGTSPSEGSAPGTSESATPESGPGTSESATPESGP GSEPATSGSETPGTSESATPESGPGTSESATPESGPGTSTEPSEGSAPGTSESAT PESGPGTSTEPSEGSAPGTSPSGESSTAPGTSPSGESSTAPGTSPSGESSTAPGT STEPSEGSAPGSPAGSPTSTEEGTSTEPSEGSAPGSSPSASTGTGPGSSTPSGAT GSPGSSTPSGATGSPGSSTPSGATGSPGASPGTSSTGSPGAS ASGAPSTGGTSPSGESSTAPGSTSSTAESPGPGTSPSGESSTAPGTSESATPESG PGTSTEPSEGSAPGTSTEPSEGSAPGSSPSASTGTGPGSSTPSGATGSPGASPGT SSTGSPGTSTPESGSASPGTSPSGESSTAPGTSPSGESSTAPGTSESATPESGPG SEPATSGSETPGTSTEPSEGSAPGSTSESPSGTAPGTSTEPSEGSAPGTSTPESG SASPGSPAGSPTSTEEGTSESATPESGPGTSTEPSEGSAPGSPAGSPTSTEEGTS ESATPESGPGSEPATSGSETPGSSTPSGATGSPGASPGTSSTGSPGSSTPSGATG SPGSTSESPSGTAPGTSPSGESSTAPGSTSSTAESPGPGSSTPSGATGSPGASPG TSSTGSPGTPGSGTASSSPGSPAGSPTSTEEGSPAGSPTSTEEGTSTEPSEGSAP | 666 | 4.5 |

Example 45

Calculation of TEPITOPE Scores

TEPITOPE scores of 9 mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 29 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 29 were added. The HLA*0101B score of a 9 mer peptide with the sequence FDKLPRTSG (SEQ ID NO: 667) would be the sum of 0, −1.3, 0, 0.9, 0, −1.8, 0.09, 0, 0.

To evaluate the TEPITOPE scores for long peptides one can repeat the process for all 9 mer subsequences of the sequences. This process can be repeated for the proteins encoded by other HLA alleles. Tables 30-33 give pocket potentials for the protein products of HLA alleles that occur with high frequency in the Caucasian population.

TEPITOPE scores calculated by this method range from approximately −10 to +10. However, 9 mer peptides that lack a hydrophobic amino acid (FKLMVWY (SEQ ID NO: 668)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9 mer subsequences will have TEPITOPEs in the range in the range of −1009 to −989. This method confirms that XTEN polypeptides may have few or no predicted T-cell epitopes.

TABLE 29

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 30

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 31

Pocket potential for HLA*0401B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −0.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | 0.8 | — | −1.5 | 0 | — | 0.5 |
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 32

Pocket potential for HLA*0701B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | −1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 1.1 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 33

Pocket potential for HLA*1501B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | 0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | 0.05 | 1.5 | — | 0.7 |
| K | −999 | 1.1 | 0 | −0.7 | — | −0.3 | −0.3 | — | −1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | −999 | 0.8 | 0.5 | −0.2 | — | 0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | 0.6 | 0.3 | — | −0.3 |
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | 0.4 | 0.7 | — | −0.9 |

TABLE 34

Exemplary Biological Activity, Exemplary Assays and Preferred Indications

| Biologically Active Protein | Biological Activity | Exemplary Activity Assay | Preferred Indication: |
|---|---|---|---|
| Insulin-like growth factor-1 (Mecasermin; Somazon; IGF-1; IGF-1 complex; CEP 151; CGP 35126; FK 780; Mecar; RHIGF-1; Somatomedin-1; Somatomedin-C; SOMATOKINE; MYOTROPHIN; IGEF; DepoIGF-1) | IGF-1 is a pleiotropic polypeptide with a wide range of actions in both central and peripheral nervous sytems. It is involved in growth and development and protects neurons against cell death via the activation of intracellular pathways implicating phosphatidylinositide 3/Akt kinase. | IGF-1 activity may be assayed in vitro using an serum withdrawal apoptosis-protection assay. (J Endocrinol 2000 Oct; 167(1): 165-74). Proliferation assay using breast carcinoma cell line MCF-7 (Karey 1988 Cancer Res. 48: 4083) | Diabetes mellitus; Growth disorders; Frailty; Amyotrophic lateral sclerosis; Osteoarthritis; Kidney disease & neuropathy; Dwarfism; HIV-1 infections; Myocardial ischaemia; Osteoporosis; Multiple sclerosis; Nerve disorders; Burns; diabetes; peripheral |
| Growth hormone (Posilac; Pegvisamont; Somatrem; Somatropin; TROVERT; PROTROPIN; BIO-TROPIN; HUMATROPE; NUTROPIN; NUTROPINAQ; NUTROPHIN; NORDITROPIN; GENOTROPIN; SAIZEN; SEROSTIM) | Binds to two GHR molecules and Induces signal transduction through receptor dimerization | 1) Ba/F3-GHR proliferation assay, a novel specific bioassay for serum human growth hormone. J Clin Endocrinol Metab 2000 Nov; 85(11): 4274-9 Plasma growth hormone (GH) immunoassay and tibial bioassay, Appl Physiol (2000) 89(6): 2174-8. Growth hormone (GH) receptor mediated cell mediated proliferation, Growth Horm IGF Res 2000 Oct; 10(5): 248-55 International standard for growth hormone, Horm Res 1999; 51 Suppl 1: 7-12 2) Detection of growth hormone detected by direct radioimmunoassay performed on serial dilutions of lysed cell supernatants using the Phadebas HGH PRIST kit (Farmacia). U.S. Pat. No. 4,898,830 | Acromegaly; Growth failure; Growth hormone replacement; Growth hormone deficiency; Pediatric Growth Hormone Deficiency; Adult Growth Hormone Deficiency; Idiopathic Growth Hormone Deficiency; Growth retardation; Prader-Willi Syndrome; Prader-Willi Syndrome in children 2 years or older; Growth deficiencies; Growth failure associated with chronic renal insufficiency; Osteoporosis; Postmenopausal osteoporosis; Osteopenia, Osteoclastogenesis; burns; Cachexia; Cancer Cachexia; Dwarfism; Metabolic Disorders; Obesity; Renal failure; Turner's Syndrome; Fibromyalgia; Fracture treatment; Frailty, AIDS wasting; Muscle Wasting; Short Stature; Diagnostic Agents; Female Infertility; lipodystrophy. |

TABLE 35

Exemplary GHXTEN comprising growth hormones and single XTEN

| GHXTEN Name* | Amino Acid Sequence | SEQ ID NO: |
|---|---|---|
| AD576- bovine GH | GSSESGSSEGGPGSGGEPSESGSSGSSESGSSEGGPGSSESGSSEGGPGSSESGSSEGGP GSSESGSSEGGPGSSESGSSEGGPGESPGGSSGSESGSSGPGESSSGSSESGSSEGGP GSSESGSSEGGPGSGGESSEGGPGSGGEPSESGSSGESPGGSSGSESGESPGGSSGSES GSGGEPSESGSSGSSESGSSEGGPGSGGEPSESGSSGSGGEPSESGSSGSEGSSGPGESS GESPGGSSGSESGSGGEPSESGSSGSGGEPSESGSSGSGGEPSESGSSGSSESGSSEGGP GESPGGSSGSESGESPGGSSGSESGESPGGSSGSESGESPGGSSGSSESGSSGSES GSSSESGSSEGGPGSGGEPSESGSSGSEGSSGPGESSGSSGSSEGGPGSGGEPSESGSS GSSSESGSSEGGPGSGGEPSESGSSGESPGGSSGSESGESPGGSSGSESGSSEGGP GSGGEPSESGSSGSSESGSSEGGPGSGGEPSESGSSGSGGEPSESGSSGESPGGSSGSES GSEGSSGPGESSGSSESGSSEGGPGSEGSSGPGESSGFPAMSLSGLFANAVLRAQHLH QLAADTFKEFERTYIPEGQRYSIQNTQVAFCFSETIPAPTGKNEAQQKSDLELLRISLLL IQSWLGPLQFLSRVFTNSLVFGTSDRVYEKLKDLEEGILALMRELEDGTPRAGQILKQ TYDKFDTNMRSDDALLKNYGLLSCFRKDLHKTETYLRVMKCRRFGEASCAF | 675 |
| AE576- bovine GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSTEPSEGSAPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGFPAMSLSGLFANAVLRAQHLHQLAADTFKE FERTYIPEGQRYSIQNTQVAFCFSETIPAPTGKNEAQQKSDLELLRISLLLIQSWLGPLQ FLSRVFTNSLVFGTSDRVYEKLKDLEEGILALMRELEDGTPRAGQILKQTYDKFDTN MRSDDALLKNYGLLSCFRKDLHKTETYLRVMKCRRFGEASCAF | 676 |
| AF576- bovine GH | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGSTSESPSGTAPGTSPSGESSTAPGSTSESPSGTAPGST SESPSGTAPGSTSESPSGTAPGTSTPESGSASPGSTSESPSGTAPGTSTPESGSASPGSTS STAESPGPGSTSSTAESPGPGSTSTPESGSASPGTSTPESGSASPGSTSESPSGTAPGTSTP ESGSASPGTSTPESGSASPGSTSESPSGTAPGSTSESPSGTAPGSTSESPSGTAPGSTSST AESPGPGSTSTPESGSASPGTSTPESGSASPGSTSESPSGTAPGSTSESPSGTAPGSTSTPES GSASPGSTSESPSGTAPGSTSESPSGTAPGTSTPESGSASPGTSPSGESSTAPGSTSSTAE SPGPGTSPSGESSTAPGSTSSTAESPGPGSTSTPESGSASPGSTSESPSGTAPGSTSSTAES PGPGTSTPESGSASPGTSTPESGSASPGFPAMSLSGLFANAVLRAQHLHQLAADTFKE FERTYIPEGQRYSIQNTQVAFCFSETIPAPTGKNEAQQKSDLELLRISLLLIQSWLGPLQ FLSRVFTNSLVFGTSDRVYEKLKDLEEGILALMRELEDGTPRAGQILKQTYDKFDTN MRSDDALLKNYGLLSCFRKDLHKTETYLRVMKCRRFGEASCAF | 677 |
| AE624- bovine GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPAMSLSGLFANAVLRAQHLHQLAADTFKEFERTYIPEGQR YSIQNTQVAFCFSETIPAPTGKNEAQQKSDLELLRISLLLIQSWLGPLQFLSRVFTNSLV FGTSDRVYEKLKDLEEGILALMRELEDGTPRAGQILKQTYDKFDTNMRSDDALLKN YGLLSCFRKDLHKTETYLRVMKCRRFGEASCAF | 678 |
| AD836- bovine GH | GSSESGSSEGGPGSSESGSSEGGPGESPGGSSGSESGSSGGEPSESGSSGESPGGSSGSES GESPGGSSGSESGSSGSSEGGPGSSESGSSEGGPGESPGGSSGSES GESPGGSSGSESGESPGGSSGSESGSSEGGPGSSESGSSEGGPGSSESGSSEGGP GSSESGSSEGGPGSSESGSSEGGPGSSESGSSEGGPGSGGEPSESGSSGESPGGSSGSES GESPGGSSGSESGSSGGEPSESGSSGSSESGSSEGGPGSGGEPSESGSSGSGGEPSESGSS GSEGSSGPGESSGSSESGSSEGGPGSGGEPSESGSSGESPGGSSGSESGSSGGEPSESGSS GSGGEPSESGSSGSSESGSSEGGPGSGGEPSESGSSGSGGEPSESGSSGSGGEPSESGSS GESPGGSSGSESGESPGGSSGSESGESPGGSSGSESGESPGGSSGSESGSSEGGP GSSESGSSEGGPGESPGGSSGSESGGGEPSESGSSGESGSSGPGESSGESPGGSSGSES GSEGSSGPGESSGPGGGEPSESGSSGSSESGSSGSSESGSSGPGESSGPGESSGEG SSGPGESSGSGGEPSESGSSGGGEPSESGSSGESPGGSSGSESGESPGGSSGSESGSGG EPSESGSSGSEGSSGPGESSGESPGGSSGSESGSSSGGEPSESGSSGESGSSGSES GSSEGGPGSGGEPSESGSSGSSESGSSEGGPGSSESGSSGSGGEPSESGSSGSES GSSEGGPGESPGGSSGSESGSGGEPSESGSSGESPGGSSGSESGSGGEPSESGSSGFPAM SLSGLFANAVLRAQHLHQLAADTFKEFERTYIPEGQRYSIQNTQVAFCFSETIPAPTGK NEAQQKSDLELLRISLLLIQSWLGPLQFLSRVFTNSLVFGTSDRVYEKLKDLEEGILAL | 679 |

TABLE 35-continued

Exemplary GHXTEN comprising growth hormones and single XTEN

| GHXTEN Name* | Amino Acid Sequence | SEQ ID NO: |
|---|---|---|
| | MRELEDGTPRAGQILKQTYDKFDTNMRSDDALLKNYGLLSCFRKDLHKTETYLRVM KCRRFGEASCAF | |
| AE864-bovine GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGTSTEPSEGSAPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGFPAMSLSGLFANAVLRAQHLHQLAADTFKEFERTYIPEGQRYSIQNT QVAFCFSETIPAPTGKNEAQQKSDLELLRISLLLIQSWLGPLQFLSRVFTNSLVFGTSD RVYEKLKDLEEGILALMRELEDGTPRAGQILKQTYDKFDTNMRSDDALLKNYGLLS CFRKDLHKTETYLRVMKCRRFGEASCAF | 680 |
| AF864-bovine GH | GSTSESPSGTAPGTSPSGESSTAPGSTSESPSGTAPGSTSESPSGTAPGTSTPESGSASPG TSTPESGSASPGSTSESPSGTAPGSTSESPSGTAPGTSPSGESSTAPGSTSESPSGTAPGT SPSGESSTAPGTSPSGESSTAPGSTSSTAESPGPGTSPSGESSTAPGTSPSGESSTAPGST SSTAESPGPGTSTPESGSASPGTSTPESGSASPGSTSESPSGTAPGSTSESPSGTAPGTST PESGSASPGSTSSTAESPGPGTSTPESGSASPGSTSESPSGTAPGTSPSGESSTAPGSTSS TAESPGPGTSPSGESSTAPGTSTPESGSASPGSTSSTAESPGPGSTSSTAESPGPGSTSST AESPGPGSTSSTAESPGPGTSPSGESSTAPGSTSESPSGTAPGSTSESPSGTAPGTSTPES GPXXXGASASGAPSTXXXXSESPSGTAPGSTSESPSGTAPGSTSESPSGTAPGSTSESPS GTAPGSTSESPSGTAPGSTSESPSGTAPGTSTPESGSASPGTSPSGESSTAPGTSPSGESS TAPGSTSSTAESPGPGTSPSGESSTAPGTSTPESGSASPGSTSESPSGTAPGSTSESPSGT APGTSPSGESSTAPGSTSESPSGTAPGTSTPESGSASPGTSTPESGSASPGSTSESPSGTA PGTSTPESGSASPGSTSSTAESPGPGTSESPSGTAPGSTSESPSGTAPGTSPSGESSTAP GSTSSTAESPGPGTSPSGESSTAPGTSTPESGSASPGTSPSGESSTAPGTSPSGESSTAPG TSPSGESSTAPGSTSSTAESPGPGSTSSTAESPGPGTSPSGESSTAPGSSPSASTGTGPGS STPSGATGSPGSSTPSGATGSPGFPAMSLSGLFANAVLRAQHLHQLAADTFKEFERTY IPEGQRYSIQNTQVAFCFSETIPAPTGKNEAQQKSDLELLRISLLLIQSWLGPLQFLSRV FTNSLVFGTSDRVYEKLKDLEEGILALMRELEDGTPRAGQILKQTYDKFDTNMRSDD ALLKNYGLLSCFRKDLHKTETYLRVMKCRRFGEASCAF | 681 |
| AG864-bovine GH | GASPGTSSTGSPGSSPSASTGTGPGSSPSASTGTGPGTPGSGTASSSPGSSTPSGATGSP GSNPSASTGTGPGASPGTSSTGSPGTPGSGTASSSPGSSTPSGATGSPGASPGTSSTGSP GTPGSGTASSSPGSSTPSGATGSPGASPGTSSTGSPGASPGTSSTGSPASPGTSSTGSP GTPGSGTASSSPGSSTPSGATGSPGSNPSASTGTGPGSSPSASTGTGPGSSTPSGATGSP GSSTPSGATGSPGASPGTSSTGSPGASPGTSSTGSPGASPGTSSTGSPGTPGSGTASSSP GASPGTSSTGSPGASPGTSSTGSPGASPGTSSTGSPGSSPSASTGTGPGTPGSGTASSSP GASPGTSSTGSPGASPGTSSTGSPGASPGTSSTGPGSSTPSGATGSPGSSTPSGATGSP GASPGTSSTGSPGTPGSGTASSSPGSSTPSGATGSPGSSTPSGATGSPGSSTPSGATGSP GSSPSASTGTGPGASPGTSSTGSPGASPGTSSTGSPGTPGSGTASSSPGASPGTSSTGSP GASPGTSSTGSPGASPGTSSTGSPGASPGTSSTGSPGTPGSGTASSSPGSSTPSGATGSP GTPGSGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATGSP GSSTPSGATGSPGASPGTSSTGSPGFPAMSLSGLFANAVLRAQHLHQLAADTFKEFER TYIPEGQRYSIQNTQVAFCFSETIPAPTGKNEAQQKSDLELLRISLLLIQSWLGPLQFLS RVFTNSLVFGTSDRVYEKLKDLEEGILALMRELEDGTPRAGQILKQTYDKFDTNMRS DDALLKNYGLLSCFRKDLHKTETYLRVMKCRRFGEASCAF | 682 |
| AM875-bovine GH | GTSTEPSEGSAPGSEPATSGSETPGSPAGSPTSTEEGSTSSTAESPGPGTSTPESGSASPG STSESPSGTAPGSTSESPSGTAPGTSTPESGSASPGTSTPESGSASPGSEPATSGSETPGT SESATPESGPGSPAGSPTSTEEGTSTEPSEGSAPGTSESATPESGPGTSTEPSEGSAPGTS TEPSEGSAPGSPAGSPTSTEEGTSTEPSEGSAPGTSTEPSEGSAPGTSESATPESGPGTSE SATPESGPGTSTEPSEGSAPGTSTEPSEGSAPGTSTEPSEGSAPGTSTEPSEGSAPGSEPA TSGSETPGSPAGSPTSTEEGSSTPSGATGSPGTPGSGTASSSPGSSTPSGATGSPGTSTEP SEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGTSSTAE SPGPGSTSESPSGTAPGTSPSGESSTAPGTPGSGTASSSPGSSTPSGATGSPGSSPSASTG TGPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGSTSSTAESPG PGTSTPESGSASPGSTSESPSGTAPGSTSEPSEGSAPGTSTEPSEGSAPGTSTEPSEGSAP GSSTPSGATGSPGSSPSASTGTGPGASPGTSSTGSPGSEPATSGSETPGTSESATPESGP GSPAGSPTSTEEGSSTPSGATGSPGSSPSASTGTGPGASPGTSSTGPGTSESATPESGP | 683 |

TABLE 35-continued

Exemplary GHXTEN comprising growth hormones and single XTEN

| GHXTEN Name* | Amino Acid Sequence | SEQ ID NO: |
|---|---|---|
| | GTSTEPSEGSAPGTSTEPSEGSAPGFPAMSLSGLFANAVLRAQHLHQLAADTFKEFER TYIPEGQRYSIQNTQVAFCFSETIPAPTGKNEAQQKSDLELLRISLLLIQSWLGPLQFLS RVFTNSLVFGTSDRVYEKLKDLEEGILALMRELEDGTPRAGQILKQTYDKFDTNMRS DDALLKNYGLLSCFRKDLHKTETYLRVMKCRRFGEASCAF | |
| AE912-bovine GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTET YLRVMKCRRFGEASCAF | 684 |
| AM923-bovine GH | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPSGASPGSASPGSTSESPGTAP GSTSESPSGTAPGSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGTSSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTNSLVFGTS DRVYEKLKDLEEGILALMRELEDGTPRAGQILKQTYDKFDTNMRSDDALLKNYGLL SCFRKDLHKTETYLRVMKCRRFGEASCAF | 685 |
| AD576-bovine GH G98 | GSSESGSSEGGPGSGGEPSESGSSGSSESGSSEGGPGSSESGSSEGGPGSSESGSSEGGP GSSESGSSEGGPGSSESGSSEGGPGESPGGSSGSESGSEGSSGPGESSGSSESGSSEGGP GSSESGSSEGGPGSSESGSSEGGPGSGGEPSESGSSGESPGGSSGSESGESPGGSSGSES GSGGEPSESGSSGSSESGSSEGGPGSGGEPSESGSSGSGGEPSESGSSGSSESGSSEGGP GESPGGSSGSESGSEGSPGGSSESGESGESPGGSSGSESGSSESGSSEGGP GSSESGSSEGGPGSGGEPSESGSSGSEGSSGPGESSGSSESGSSEGGPGSGGEPSESGSS GSSESGSSEGGPGSGGEPSESGSSGESPGGSSGSESGSSESGSSEGGPGSSESGSSEGGP GSGGEPSESGSSGSSESGSSEGGPGSGGEPSESGSSGSGGEPSESGSSGESPGGSSGSES GSEGSSGPGESSGSSESGSSEGGPGSEGSSGPGESSGFPAMSLSGLFANAVLRAQHLH QLAADTFKEFERTYIPEGQRYSIQNTQVAFCFSETIPAPTGKNEAQQKSDLELLRISLLL IQSWLGPLQFLSRVFTQSLVFGTSDRVYEKLKDLEEGILALMRELEDGTPRAGQILKQ TYDKFDTNMRSDDALLKNYGLLSCFRKDLHKTETYLRVMKCRRFGEASCAF | 686 |
| AE576-bovine GH G98 | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGFPAMSLSGLFANAVLRAQHLHQLAADTFKE FERTYIPEGQRYSIQNTQVAFCFSETIPAPTGKNEAQQKSDLELLRISLLLIQSWLGPLQ FLSRVFTQSLVFGTSDRVYEKLKDLEEGILALMRELEDGTPRAGQILKQTYDKFDTN MRSDDALLKNYGLLSCFRKDLHKTETYLRVMKCRRFGEASCAF | 687 |

TABLE 35-continued

Exemplary GHXTEN comprising growth hormones and single XTEN

| GHXTEN Name* | Amino Acid Sequence | SEQ ID NO: |
|---|---|---|
| AF576-bovine GH G98 | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGTSESPSGTAPGTSPSGESSTAPGSTSESPSGTAPGST SESPSGTAPGSTSESPSGTAPGTSTPESGSASPGSTSESPSGTAPGTSTPESGSASPGSTS STAESPGPGSTSSTAESPGPGTSTPESGSASPGTSTPESGSASPGSTSESPSGTAPGTSTP ESGSAPGTSTPESGSASPGSTSESPSGTAPGSTSESPSGTAPGSTSESPSGTAPGSTSST AESPGPGTSTPESGSASPGTSTPESGSASPGSTSESPSGTAPGSTSESPSGTAPGTSTPES GSASPGSTSESPSGTAPGSTSESPSGTAPGTSTPESGSASPGTSPSGESSTAPGSTSSTAE SPGPGTSPSGESSTAPGSTSSTAESPGPGTSTPESGSASPGSTSESPSGTAPGSTSSTAES PGPGTSTPESGSASPGTSTPESGSASPGFPAMSLSGLFANAVLRAQHLHQLAADTFKE FERTYIPEGQRYSIQNTQVAFCFSETIPAPTGKNEAQQKSDLELLRISLLLIQSWLGPLQ FLSRVFTQSLVFGTSDRVYEKLKDLEEGILALMREDGTPRAGQILKQTYDKFDTN MRSDDALLKNYGLLSCFRKDLHKTETYLRVMKCRRFGEASCAF | 688 |
| AE624-bovine GH G98 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPAMSLSGLFANAVLRAQHLHQLAADTFKEFERTYIPEGQR YSIQNTQVAFCFSETIPAPTGKNEAQQKSDLELLRISLLLIQSWLGPLQFLSRVFTQSLV FGTSDRVYEKLKDLEEGILALMREDGTPRAGQILKQTYDKFDTNMRSDDALLKN YGLLSCFRKDLHKTETYLRVMKCRRFGEASCAF | 689 |
| AD836-bovine GH G98 | GSSESGSSEGGPGSSESGSSEGGPGESPGGSSGSESGSGGEPSESGSSGESPGGSSGSES GESPGGSSGSESGSSESGSSEGGPGSSESGSSEGGPGSSESGSSEGGPGESPGGSSGSES GESPGGSSGSESGESPGGSSGSESGSSESGSSEGGPGSSESGSSEGGPGSSESGSSEGGP GSSESGSSEGGPGSSESGSSEGGPGSSESGSSEGGPGSSGEPSESGSSGESPGGSSGSES GESPGGSSGSESGSGGEPSESGSSGSEGSSGPGESSGSSESGSSEGGPGSSGGEPSESGSS GSEGSSGPGSSESGSSESGSSEGGPGSSGGEPSESGSSGSGGEPSESGSSGSEGSSGPGESS GESPGGSSGSESGSEGSSGPGESSGSEGSSGPGSSGGEPSESGSSGSEGSSGPGESSGPGESS GSSESGSSEGGPGESPGGSSGSESGSGGEPSESGSSGSEGSSGPGESSGESPGGSSGSES GSEGSSPGSSESGSSEGGPGSGGEPSESGSSGEGSSGPGESSGPGESSGPGESSGPGESSGPGESSGSG SSGPGESSGSGGEPSESGSSGGGEPSESGSSGESPGGSSGSESGESPGGSSGSESGSGG EPSESGSSGSEGSSGPGESSGESPGGSSGSESGSSESGSSEGGPGSSESGSSEGGPGSSES GSSEGGPGSGGEPSESGSSGSSESGSSEGGPGESPGGSSGSESGSGGEPSESGSSGSSES GSSEGGPGESPGGSSGSSGGEPSESGSSGESPGGSSGSESGGGEPSESGSSGFPAM SLSGLFANAVLRAQHLHQLAADTFKEFERTYIPEGQRYSIQNTQVAFCFSETIPAPTGK NEAQQKSDLELLRISLLLIQSWLGPLQFLSRVFTQSLVFGTSDRVYEKLKDLEEGILAL MREDGTPRAGQILKQTYDKFDTNMRSDDALLKNYGLLSCFRKDLHKTETYLRVM KCRRFGEASCAF | 690 |
| AE864-bovine GH G98 | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGFPAMSLSGLFANAVLRAQHLHQLAADTFKEFERTYIPEGQRYSIQNT QVAFCFSETIPAPTGKNEAQQKSDLELLRISLLLIQSWLGPLQFLSRVFTQSLVFGTSD RVYEKLKDLEEGILALMREDGTPRAGQILKQTYDKFDTNMRSDDALLKNYGLLS CFRKDLHKTETYLRVMKCRRFGEASCAF | 691 |
| AF864-bovine GH G98 | GSTSESPSGTAPGTSPSGESSTAPGSTSESPSGTAPGSTSESPSGTAPGTSTPESGSASPG TSTPESGSASPGSTSESPSGTAPGSTSESPSGTAPGTSPSGESSTAPGSTSESPSGTAPGT SPSGESSTAPGSTSSTAESPGPGTSPSGESSTAPGTSPSGESSTAPGST SSTAESPGPGTSTPESGSASPGSTSPESGSASPGSTSESPSGTAPGSTSESPSGTAPGTST PESGSASPGSTSSTAESPGPGTSTPESGSASPGSTSESPSGTAPGTSPSGESSTAPGSTSS TAESPGPGTSPSGESSTAPGTSTPESGSASPGSTSSTAESPGPGSTSSTAESPGPGSTSST | 692 |

TABLE 35-continued

Exemplary GHXTEN comprising growth hormones and single XTEN

| GHXTEN Name* | Amino Acid Sequence | SEQ ID NO: |
|---|---|---|
| | AESPGPGSTSSTAESPGPGTSPSGESSTAPGSTSESPSGTAPGSTSESPSGTAPGTSTPES GPXXXGASASGAPSTXXXXSESPSGTAPGSTSESPSGTAPGSTSESPSGTAPGSTSESPS GTAPGSTSESPSGTAPGSTSESPSGTAPGTSPESGSASPGTSPSGESSTAPGTSPSGESS TAPGSTSSTAESPGPGTSPSGESSTAPGTSTPESGSASPGSTSESPSGTAPGSTSESPSGT APGTSPSGESSTAPGSTSESPSGTAPGTSTPESGSASPGTSTPESGSASPGSTSESPSGTA PGTSTPESGSASPGSTSSTAESPGPGTSTSESPSGTAPGTSESPSGTAPGTSPSGESSTAP GSTSSTAESPGPGTSPSGESSTAPGTSTPESGSASPGTSPSGESSTAPGTSPSGESSTAPG TSPSGESSTAPGSTSSTAESPGPGSTSSTAESPGPGTSPSGESSTAPGSSPSASTGTGPGS STPSGATGSPGSSTPSGATGSPGFPAMSLSGLFANAVLRAQHLHQLAADTFKEFERTY IPEGQRYSIQNTQVAFCFSETIPAPTGKNEAQQKSDLELLRISLLLIQSWLGPLQFLSRV FTQSLVFGTSDRVYEKLKDLEEGILALMRELEDGTPRAGQILKQTYDKFDTNMRSDD ALLKNYGLLSCFRKDLHKTETYLRVMKCRRFGEASCAF | |
| AG864-bovine GH G98 | GASPGTSSTGSPGSSPSASTGTGPGSSPSASTGTGPGTPGSGTASSSPGSSTPSGATGSP GSNPSASTGTGPGASPGTSSTGSPGTPGSGTASSSPGSSTPSGATGSPGTPGSGTASSSP GASPGTSSTGSPGASPGTSSTGSPGTPGSGTASSSPGSSTPSGATGSPGASPGTSSTGSP GTPGSGTASSSPGSSTPSGATGSPGSNPSASTGTGPGSSPSASTGTGPGSSTPSGATGSP GSSTPSGATGSPGASPGTSSTGSPGASPGTSSTGSPGASPGTSSTGSPGTPGSGTASSSP GASPGTSSTGSPGASPGTSSTGSPGASPGTSSTGSPGSSPSASTGTGPGTPGSGTASSSP GASPGTSSTGSPGASPGTSSTGSPGASPGTSSTGSPGSSTPSGATGSPGSSTPSGATGSP GASPGTSSTGSPGTPGSGTASSSPGSSTPSGATGSPGSSTPSGATGSPGSSTPSGATGSP GSSPSASTGTGPGASPGTSSTGSPGASPGTSSTGSPGTPGSGTASSSPGASPGTSSTGSP GASPGTSSTGSPGASPGTSSTGSPGASPGTSSTGSPGTPGSGTASSSPGSSTPSGATGSP GTPGSGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATGSP GSSTPSGATGSPGASPGTSSTGSPGFPAMSLSGLFANAVLRAQHLHQLAADTFKEFER TYIPEGQRYSIQNTQVAFCFSETIPAPTGKNEAQQKSDLELLRISLLLIQSWLGPLQFLS RVFTQSLVFGTSDRVYEKLKDLEEGILALMRELEDGTPRAGQILKQTYDKFDTNMRS DDALLKNYGLLSCFRKDLHKTETYLRVMKCRRFGEASCAF | 693 |
| AM875-bovine GH G98 | GTSTEPSEGSAPGSEPATSGSETPGSPAGSPTSTEEGSTSSTAESPGPGTSTPESGSASPG STSESPSGTAPGSTSESPSGTAPGTSTPESGSASPGTSTPESGSASPGSEPATSGSETPGT SESATPESGPGSPAGSPTSTEEGTSTEPSEGSAPGTSESATPESGPGTSTEPSEGSAPGTS TEPSEGSAPGSPAGSPTSTEEGTSTEPSEGSAPGTSTEPSEGSAPGTSESATPESGPGTSE SATPESGPGTSTEPSEGSAPGTSTEPSEGSAPGTSESATPESGPGTSTEPSEGSAPGSEPA TSGSETPGSPAGSPTSTEEGSSTPSGATGSPGTPGSGTASSSPGSSTPSGATGSPGTSTEP SEGSAPGTSTEPSEGSAPGSEPATSGSETPGSPAGSPTSTEEGSPAGSPTSTEEGTSTEPS EGSAPGASASGAPSTGGTSTAESATPESGPGSPAGSPTSTEEGSPAGSPTSTEEGSTSSTAE SPGPGSTSESPSGTAPGTSPSGESSTAPGTPGSGTASSSPGSSTPSGATGSPGSSPSASTG TGPGSEPATSGSETPGTSESATPESGPGSEPATSGSETPGSTSSTAESPGPGSTSSTAESP GPGTSPSGESSTAPGSEPATSGSETPGSEPATSGSETPGTSTEPSEGSAPGSTSSTAESPG PGTSTPESGSASPGSTSESPSGTAPGTSTEPSEGSAPGTSTEPSEGSAPGTSTEPSEGSAP GSSTPSGATGSPGSSPSASTGTGPGASPGTSSTGSPGSEPATSGSETPGTSESATPESGP GSPAGSPTSTEEGSSTPSGATGSPGSSPSASTGTGPGASPGTSSTGSPGTSESATPESGP GTSTEPSEGSAPGTSTEPSEGSAPGFPAMSLSGLFANAVLRAQHLHQLAADTFKEFER TYIPEGQRYSIQNTQVAFCFSETIPAPTGKNEAQQKSDLELLRISLLLIQSWLGPLQFLS RVFTQSLVFGTSDRVYEKLKDLEEGILALMRELEDGTPRAGQILKQTYDKFDTNMRS DDALLKNYGLLSCFRKDLHKTETYLRVMKCRRFGEASCAF | 694 |
| AE912-bovine GH G98 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGTSTEPSEGSAPGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTQSLVFGTSDRVYEKLKDLE EGILALMRELEDGTPRAGQILKQTYDKFDTNMRSDDALLKNYGLLSCFRKDLHKTET YLRVMKCRRFGEASCAF | 695 |
| AM923-bovine GH G98 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG | 696 |

TABLE 35-continued

Exemplary GHXTEN comprising growth hormones and single XTEN

| GHXTEN Name* | Amino Acid Sequence | SEQ ID NO: |
|---|---|---|
| | SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTQSLVFGTS DRVYEKLKDLEEGILALMRELEDGTPRAGQILKQTYDKFDTNMRSDDALLKNYGLL SCFRKDLHKTETYLRVMKCRRFGEASCAF | |
| AD576-porcine GH | GSSESGSSEGGPGSGGEPSESGSSGSSESGSSEGGPGSSESGSSEGGPGSSESGSSEGGP GSSESGSSEGGPGSSESGSSEGGPGESPGGSSGSESGSSGPGESSGSESGSSEGGP GSSESGSSEGGPGSSESGSSEGGPGSGGEPSESGSSGESPGGSGSESGSPGGSSGSES GSGGEPSESGSSGSSESGSSEGGPGSGGEPSESGSSGSGGEPSESGSSGSESGSSGPGESS GESPGGSSGSESGSGGEPSESGSSGSGGEPSESGSSGSSESGSSEGGP GESPGGSSGSESGESPGGSSGSESGESPGGSSGSESGESPGGSSGSES GSSESGSSEGGPGSGGEPSESGSSGSEGSSGPGESSGSSESGSSEGGPGSGGEPSESGSS GSSESGSSEGGPGSGGEPSESGSSGESPGGSSGSESGESPGGSSGSESGSSESGSSEGGP GSGGEPSESGSSGSSESGSSEGGPGSGGEPSESGSSGSGGEPSESGSSGESPGGSSGSES GSEGSSGPGESSGSSESGSSEGGPGSEGSSGPGESSGFPTMPLSSLFANAVLRAQHLHQ LAADTYKEFERAYIPEGQRYSIQNAQAAFCFSETIPAPTGKDEAQQRSDVELLRFSLLL IQSWLGPVQFLSRVFTNSLVFGTSDRVYEKLKDLEEGIQALMRELEDGSPRAGQILKQ TYDKFDTNLRSDDALLKNYGLLSCFKKDLHKAETYLRVMKCRRFVESSCAF | 697 |
| AE576-porcine GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGFPTMPLSSLFANAVLRAQHLHQLAADTYKE FERAYIPEGQRYSIQNAQAAFCFSETIPAPTGKDEAQQRSDVELLRFSLLLIQSWLGPV QFLSRVFTNSLVFGTSDRVYEKLKDLEEGIQALMRELEDGSPRAGQILKQTYDKFDT NLRSDDALLKNYGLLSCFKKDLHKAETYLRVMKCRRFVESSCAF | 698 |
| AF576-porcine GH | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGSTSPSGESSTAPGSTSESPSGTAPGSTSESPSGTAPGT SESPSGTAPGSTSESPSGTAPGTSTPESGSASPGSTSESPSGTAPGTSTPESGSASPGSTS STAESPGPGSTSSTAESPGPGTSTPESGSASPGTSTPESGSASPGSTSESPSGTAPGTSTP ESGSASPGTSTPESGSASPGSTSESPSGTAPGSTSESPSGTAPGSTSESPSGTAPGSTSST AESPGPGTSTPESGSASPGTSTPESGSASPGSTSESPSGTAPGSTSESPSGTAPGSTSPES GSASPGSTSESPSGTAPGSTSESPSGTAPGTSTPESGSASPGTSPSGESSTAPGSTSSTAE SPGPGTSPSGESSTAPGSTSSTAESPGPGTSTPESGSASPGSTSESPSGTAPGSTSSTAES PGPGTSTPESGSASPGTSTPESGSASPGFPTMPLSSLFANAVLRAQHLHQLAADTYKEF ERAYIPEGQRYSIQNAQAAFCFSETIPAPTGKDEAQQRSDVELLRFSLLLIQSWLGPVQ FLSRVFTNSLVFGTSDRVYEKLKDLEEGIQALMRELEDGSPRAGQILKQTYDKFDTNL RSDDALLKNYGLLSCFKKDLHKAETYLRVMKCRRFVESSCAF | 699 |
| AE624-porcine GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPTMPLSSLFANAVLRAQHLHQLAADTYKEFERAYIPEGQR YSIQNAQAAFCFSETIPAPTGKDEAQQRSDVELLRFSLLLIQSWLGPVQFLSRVFTNSL VFGTSDRVYEKLKDLEEGIQALMRELEDGSPRAGQILKQTYDKFDTNLRSDDALLKN YGLLSCFKKDLHKAETYLRVMKCRRFVESSCAF | 700 |

TABLE 35-continued

Exemplary GHXTEN comprising growth hormones and single XTEN

| GHXTEN Name* | Amino Acid Sequence | SEQ ID NO: |
|---|---|---|
| AD836-porcine GH | GSSESGSSEGGPGSSESGSSEGGPGESPGGSSGSESGSGGEPSESGSSGESPGGSSGSES GESPGGSSGSESGSSEGGPGSSESGSSEGGPGSSESGSSEGGPGESPGGSSGSES GESPGGSSGSESGESPGGSSGSESGSSGGEPSESGSSEGGPGSGGEPSESGSSGESPGGSSGSES GSSESGSSEGGPGSSESGSSEGGPGSSESGSSEGGPGSGGEPSESGSSGESPGGSSGSES GESPGGSSGSESGSGGEPSESGSSGSEGSSGPGESSGSSESGSSEGGPGSGGEPSESGSS GSSGSPGESSGSSESGSSEGGPGSGGEPSESGSSGESPGGSSGSESGSGGEPSESGSS GSGGEPSESGSSGSSEGGPGSSESGSSGSEGGPGSSESGSGSSESGSSEGGPGESS GESPGGSSGSESGSEGSSGPGESSGSEGSSGPGESSGSGGEPSESGSGSSESGSSEGGP GSSESGSSEGGPGESPGGSSGSESGSGGEPSESGSSGSEGSSGPGESSGESPGGSSGSES GSEGSSGPGSSESGSSEGGPGSGGEPSESGSSGSEGSSGPGESSGSEGSSGPGESSGSEG SSGPGESSGSGGEPSESGSSGGGEPSESGSSGESPGGSSGESGESPGGSSGSESGSGG EPSESGSSGSEGSSGPGESSGESPGGSSGSESGSSEGGPGSSESGSSEGGPGSSES GSSEGGPGSGGEPSESGSSGSSESGSSEGGPGESPGGSSGSESGSGGEPSESGSSGSES GSSEGGPGESPGGSSGSESGSGGEPSESGSSGESPGGSSGSESGSGGEPSESGSSGFPTM PLSSLFANAVLRAQHLHQLAADTYKEFERAYIPEGQRYSIQNAQAAFCFSETIPAPTG KDEAQQRSDVELLRFSLLLIQSWLGPVQFLSRVFTNSLVFGTSDRVYEKLKDLEEGIQ ALMRELEDGSPRAGQILKQTYDKFDTNLRSDDALLKNYGLLSCFKKDLHKAETYLR VMKCRRFVESSCAF | 701 |
| AE864-porcine GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGFPTMPLSSLFANAVLRAQHLHQLAADTYKEFERAYIPEGQRYSIQNA QAAFCFSETIPAPTGKDEAQQRSDVELLRFSLLLIQSWLGPVQFLSRVFTNSLVFGTSD RVYEKLKDLEEGIQALMRELEDGSPRAGQILKQTYDKFDTNLRSDDALLKNYGLLSC FKKDLHKAETYLRVMKCRRFVESSCAF | 702 |
| AF864-porcine GH | GSTSESPSGTAPGTSPSGESSTAPGSTSESPSGTAPGSTSESPSGTAPGTSTPESGSASPG TSTPESGSASPGSTSESPSGTAPGSTSESPSGTAPGTSPSGESSTAPGSTSESPSGTAPGT SPSGESSTAPGSTSSTAESPGPGTSTPESGSASPGTSTPESGSASPGSTSESPSGTAPGTSTST PESGSASPGTSSTAESPGPGTSTPESGSASPGSTSESPSGTAPGSTSSTAESPGPGSTSS TAESPGPGTSPSGESSTAPGTSTPESGSASPGSTSSTAESPGPGSTSSTAESPGPGSTSST AESPGPGSTSSTAESPGPGTSPSGESSTAPGSTSESPSGTAPGSTSESPSGTAPGTSTPES GPXXXGASASGAPSTXXXXSESPSGTAPGSTSESPSGTAPGSTSESPSGTAPGSTSESPS GTAPGSTSESPSGTAPGSTSESPSGTAPGTSTPESGSASPGTSPSGESSTAPGTSPSGESS TAPGSTSSTAESPGPGTSPSGESSTAPGTSTPESGSASPGSTSESPSGTAPGSTSESPSGT APGTSPSGESSTAPGSTSESPSGTAPGTSTPESGSASPGTSTPESGSASPGSTSESPSGTA PGTSTPESGSASPGSTSSTAESPGPGSTSESPSGTAPGSTSESPSGTAPGTSPSGESSTAP GSTSSTAESPGPGTSPSGESSTAPGTSTPESGSASPGTSPSGESSTAPGTSPSGESSTAPG TSPSGESSTAPGSTSSTAESPGPGSTSSTAESPGPGTSPSGESSTAPGSSASTGTGPGSS STPSGATGSPGSSTPSGATGSPGFPTMPLSSLFANAVLRAQHLHQLAADTYKEFERAY IPEGQRYSIQNAQAAFCFSETIPAPTGKDEAQQRSDVELLRFSLLLIQSWLGPVQFLSR VFTNSLVFGTSDRVYEKLKDLEEGIQALMRELEDGSPRAGQILKQTYDKFDTNLRSD DALLKNYGLLSCFKKDLHKAETYLRVMKCRRFVESSCAF | 703 |
| AG864-porcine GH | GASPGTSSTGSPGSSPSASTGTGPGSSPSASTGTGPGTPGSGTASSSPGSSTPSGATGSP GSNPSASTGTGPGASPGTSSTGSPGTPGSGTASSSPGSSTPSGATGSPGTPGSGTASSSP GASPGTSSTGSPGASPGTSSTGSPGTPGSGTASSSPGSSTPSGATGSPGASPGTSSTGSP GTPGSGTASSSPGSSTPSGATGSPGSNPSASTGTGPGSSPSASTGTGPGSSTPSGATGSP GSSTPSGATGSPGASPGTSSTGSPGASPGTSSTGSPGASPGTSSTGSPGTPGSGTASSSP GASPGTSSTGSPGASPGTSSTGSPGASPGTSSTGSPGSSTPSGATGSPGSSTPSGATGSP GASPGTSSTGSPGASPGTSSTGSPGASPGTSSTGSPGSSTPSGATGSPGSSTPSGATGSP GSSPSASTGTGPGASPGTSSTGSPGASPGTSSTGSPGTPGSGTASSSPGASPGTSSTGSP GASPGTSSTGSPGASPGTSSTGSPGTPGSGTASSSPGSSTPSGATGSPGSSTPSGATGSP GTPGSGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATGSP GSSTPSGATGSPGASPGTSSTGSPGFPTMPLSSLFANAVLRAQHLHQLAADTYKEFER AYIPEGQRYSIQNAQAAFCFSETIPAPTGKDEAQQRSDVELLRFSLLLIQSWLGPVQFL | 704 |

TABLE 35-continued

Exemplary GHXTEN comprising growth hormones and single XTEN

| GHXTEN Name* | Amino Acid Sequence | SEQ ID NO: |
|---|---|---|
| | SRVFTNSLVFGTSDRVYEKLKDLEEGIQALMRELEDGSPRAGQILKQTYDKFDTNLRS<br>DDALLKNYGLLSCFKKDLHKAETYLRVMKCRRFVESSCAF | |
| AM875-<br>porcine<br>GH | GTSTEPSEGSAPGSEPATSGSETPGSPAGSPTSTEEGSTSSTAESPGPGTSTPESGSASPG<br>STSESPSGTAPGSTSESPSGTAPGTSTPESGSASPGTSTPESGSASPGSEPATSGSETPGT<br>SESATPESGPGSPAGSPTSTEEGTSTEPSEGSAPGTSESATPESGPGTSTEPSEGSAPGTS<br>TEPSEGSAPGSPAGSPTSTEEGTSTEPSEGSAPGTSTEPSEGSAPGTSESATPESGPGTSE<br>SATPESGPGTSTEPSEGSAPGTSTEPSEGSAPGTSESATPESGPGTSTEPSEGSAPGSEPA<br>TSGSETPGSPAGSPTSTEEGSSTPSGATGSPGTPGSGTASSSPGSSTPSGATGSPGTSTEP<br>SEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGSTSSTAE<br>SPGPGSTSESPSGTAPGTSPSGESSTAPGTPGSGTASSSPGSSTPSGATGSPGSSPSASTG<br>TGPGSEPATSGSETPGTSESATPESGPGSEPATSGSETPGTSSTAESPGPGSTSSTAESP<br>GPGTSPSGESSTAPGSEPATSGSETPGSEPATSGSETPGTSTEPSEGSAPGSTSSTAESPG<br>PGTSTPESGSASPGSTSESPSGTAPGTSTEPSEGSAPGTSTEPSEGSAPGTSTEPSEGSAP<br>GSSTPSGATGSPGSSPSASTGTGPGASPGTSSTGSPGSEPATSGSETPGTSESATPESGP<br>GSPAGSPTSTEEGSSTPSGATGSPGSSPSASTGTGPGASPGTSSTGSPGTSESATPESGP<br>GTSTEPSEGSAPGTSTEPSEGSAPGFPTMPLSSLFANAVLRAQHLHQLAADTYKEFER<br>AYIPEGQRYSIQNAQAAFCFSETIPAPTGKDEAQQRSDVELLRFSLLLIQSWLGPVQFL<br>SRVFTNSLVFGTSDRVYEKLKDLEEGIQALMRELEDGSPRAGQILKQTYDKFDTNLRS<br>DDALLKNYGLLSCFKKDLHKAETYLRVMKCRRFVESSCAF | 705 |
| AE912-<br>porcine<br>GH | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPTMPLSSLFANAVLRAQHLHQLAADTYKEFERAYIPEGQRYSIQNAQAAFCFSETIP<br>APTGKDEAQQRSDVELLRFSLLLIQSWLGPVQFLSRVFTNSLVFGTSDRVYEKLKDLE<br>EGIQALMRELEDGSPRAGQILKQTYDKFDTNLRSDDALLKNYGLLSCFKKDLHKAET<br>YLRVMKCRRFVESSCAF | 706 |
| AM923-<br>porcine<br>GH | MAEPAGSPTSTEEGASPGTSSTGSPGSSTPSGATGSPGSSTPSGATGSPGTSTEPSEGSA<br>PGSEPATSGSETPGSPAGSPTSTEEGSTSSTAESPGPGTSTPESGSASPGSTSESPSGTAP<br>GSTSESPSGTAPGTSTPESGSASPGTSTPESGSASPGSEPATSGSETPGTSESATPESGPG<br>SPAGSPTSTEEGTSTEPSEGSAPGTSESATPESGPGTSTEPSEGSAPGTSTEPSEGSAPGS<br>PAGSPTSTEEGTSTEPSEGSAPGTSTEPSEGSAPGTSESATPESGPGTSESATPESGPGTS<br>TEPSEGSAPGTSTEPSEGSAPGTSESATPESGPGTSTEPSEGSAPGSEPATSGSETPGSPA<br>GSPTSTEEGSSTPSGATGSPGTPGSGTASSSPGSSTPSGATGSPGTSTEPSEGSAPGTSTE<br>PSEGSAPGSEPATSGSETPGSPAGSPTSTEEGSPAGSPTSTEEGTSTEPSEGSAPGASAS<br>GAPSTGGTSESATPESGPGSPAGSPTSTEEGSPAGSPTSTEEGSTSSTAESPGPGSTSESP<br>SGTAPGTSPSGESSTAPGTPGSGTASSSPGSSTPSGATGSPGSSPSASTGTGPGSEPATS<br>GSETPGTSESATPESGPGSEPATSGSETPGTSSTAESPGPGSTSSTAESPGPGTSPSGES<br>STAPGSEPATSGSETPGSEPATSGSETPGTSTEPSEGSAPGTSSTAESPGPGTSTPESGS<br>ASPGSTSESPSGTAPGTSTEPSEGSAPGTSTEPSEGSAPGTSTEPSEGSAPGSSTPSGATG<br>SPGSSPSASTGTGPGASPGTSSTGSPGSEPATSGSETPGTSESATPESGPGSPAGSPTSTE<br>EGSSTPSGATGSPGSSPSASTGTGPGASPGTSSTGSPGTSESATPESGPGTSTEPSEGSAP<br>GTSTEPSEGSAPGFPTMPLSSLFANAVLRAQHLHQLAADTYKEFERAYIPEGQRYSIQ<br>NAQAAFCFSETIPAPTGKDEAQQRSDVELLRFSLLLIQSWLGPVQFLSRVFTNSLVFGT<br>SDRVYEKLKDLEEGIQALMRELEDGSPRAGQILKQTYDKFDTNLRSDDALLKNYGLL<br>SCFKKDLHKAETYLRVMKCRRFVESSCAF | 707 |
| AD576-<br>chicken<br>GH | GSSESGSSEGGPGSGGEPSESGSSGSSESGSSEGGPGSSESGSSEGGPGSSESGSSEGGP<br>GSSESGSSEGGPGSSESGSSEGGPGESPGGSGSESGSEGSSGPGESSGSSESGSSEGGP<br>GSSESGSSEGGPGSSESGSSEGGPGSGGEPSESGSSGESPGGSSGSESGESPGGSSGSES<br>GSGGEPSESGSSGSSESGSSEGGPGSGGEPSESGSSGSGGEPSESGSSGEGSSGPGESS<br>GESPGGSSGSESGSGGEPSESGSSGSSESGSSEGGPGSSESGSSEGGPGSSESGSGPGSPA<br>GESPGGSSGSESGESPGGSSGESGESPGGSSESGSSEGGPGSSESGSSEGGPGSSGSES<br>GSSESGSSEGGPGSGGEPSESGSSGSEGSSGPGESSGSESGSSEGGPGSGGEPSESGSS<br>GSSESGSSEGGPGSGGEPSESGSSGESPGGSSGSESGESPGGSSGSESGSSESGSSEGGP<br>GSGGEPSESGSSGSSESGSSEGGPGSGGEPSESGSSGSGGEPSESGSSGESPGGSSGSES<br>GSEGSSGPGESSGSSESGSSEGGPGSEGSSGPGESSGFPAMPLSNLFANAVLRAQHLHL<br>LAAETYKEFERTYIPEDQRYTNKNSQAAFCYSETIPAPTGKDDAQQKSDMELLRFSLV | 708 |

TABLE 35-continued

Exemplary GHXTEN comprising growth hormones and single XTEN

| GHXTEN Name* | Amino Acid Sequence | SEQ ID NO: |
|---|---|---|
| | LIQSWLTPVQYLSKVFTNNLVFGTSDRVFEKLKDLEEGIQALMRELEDRSPRGPQLLR PTYDKFDIHLRNEDALLKNYGLLSCFKKDLHKVETYLKVMKCRRFGESNCTI | |
| AE576-chicken GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGFPAMPLSNLFANAVLRAQHLHLLAAETYKE FERTYIPEDQRYTNKNSQAAFCYSETIPAPTGKDDAQQKSDMELLRFSLVLIQSWLTP VQYLSKVFTNNLVFGTSDRVFEKLKDLEEGIQALMRELEDRSPRGPQLLRPTYDKFDI HLRNEDALLKNYGLLSCFKKDLHKVETYLKVMKCRRFGESNCTI | 709 |
| AF576-chicken GH | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGSTSESPSGTAPGTSPSGESSTAPGSTSESPSGTAPGST SESPSGTAPGSTSESPSGTAPGTSTPESGSASPGSTSESPSGTAPGTSTPESGSASPGSTS STAESPGPGSTSSTAESPGPGTSTPESGSASPGTSTPESGSASPGSTSESPSGTAPGTSTP ESGSASPGTSTPESGSASPGTSTSESPSGTAPGSTSESPSGTAPGSTSESPSGTAPGTSST AESPGPGTSTPESGSASPGTSTPESGSASPGSTSESPSGTAPGSTSESPSGTAPGTSTPES GSASPGSTSESPSGTAPGSTSESPSGTAPGTSTPESGSASPGTSPSGESSTAPGSTSSTAE SPGPGTSPSGESSTAPGSTSSTAESPGPGTSTPESGSASPGTSTSESPSGTAPGSTSSTAES PGPGTSTPESGSASPGTSTPESGSASPGFPAMPLSNLFANAVLRAQHLHLLAAETYKEF ERTYIPEDQRYTNKNSQAAFCYSETIPAPTGKDDAQQKSDMELLRFSLVLIQSWLTPV QYLSKVFTNNLVFGTSDRVFEKLKDLEEGIQALMRELEDRSPRGPQLLRPTYDKFDIH LRNEDALLKNYGLLSCFKKDLHKVETYLKVMKCRRFGESNCTI | 710 |
| AE624-chicken GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPAMPLSNLFANAVLRAQHLHLLAAETYKEFERTYIPEDQR YTNKNSQAAFCYSETIPAPTGKDDAQQKSDMELLRFSLVLIQSWLTPVQYLSKVFTN NLVFGTSDRVFEKLKDLEEGIQALMRELEDRSPRGPQLLRPTYDKFDIHLRNEDALLK NYGLLSCFKKDLHKVETYLKVMKCRRFGESNCTI | 711 |
| AD836-chicken GH | GSSESGSSEGGPGSSESGSSEGGPGESPGGSSGSESGSGGEPSESGSSGESPGGSSGSES GESPGGSSGSESGSSEGGPGSSESGSSEGGPGSSESGSSEGGPGESPGGSSGSESGSSES GESPGGSSGSESGESPGGSSGSESGSSGGEPSESGSSEGGPGSSESGSSEGGPGESPGSGG GSSESGSSEGGPGSSESGSSEGGPGSSESGSSEGGPGSGGEPSESGSSGESPGGSSGSES GESPGGSGSESGSGGEPSESGSSGSEGSSGPGESSGSSESGSSEGGPGSGGEPSESGSS GEGSSGPGESSEGGPGSSGGEPSESGSSGSESGSSEGGPGSGGEPSESGSSGSGGEPSESGSS GSGGEPSESGSSGSSESGSSEGGPGSGGEPSESGSSGSEGSSGPGESSGESSGPGESS GESPGGSSGSESGSEGSSGPGESSGSEGSSGPGESSGSGGEPSESGSSGSESGSSEGGP GSSESGSSEGGPGESPGGSSGSESGSGGEPSESGSSGSEGSSGPGESSGESPGGSSGSES GSEGSSGPGSSESGSSEGGPGSGGEPSESGSSGSEGSSGPGESSGSEGSSGPGESSGSEG SSGPGESSSGGEPSESGSSGGEPSESGSSGPGSSESGSSESGSSEGGPGSSESGSSEGGPGSSES EPSESGSSGSEGSGPGESSGESPGGSSGSESGSSESGSSEGGPGSSESGSSEGGPGSSES GSSEGGPGSGGEPSESGSSGSSESGSSEGGPGESPGGSSGSESGSGGEPSESGSSGFPAM PLSNLFANAVLRAQHLHLLAAETYKEFERTYIPEDQRYTNKNSQAAFCYSETIPAPTG KDDAQQKSDMELLRFSLVLIQSWLTPVQYLSKVFTNNLVFGTSDRVFEKLKDLEEGI QALMRELEDRSPRGPQLLRPTYDKFDIHLRNEDALLKNYGLLSCFKKDLHKVETYLK VMKCRRFGESNCTI | 712 |
| AE864-chicken GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS | 713 |

TABLE 35-continued

Exemplary GHXTEN comprising growth hormones and single XTEN

| GHXTEN Name* | Amino Acid Sequence | SEQ ID NO: |
|---|---|---|
| | TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGFPAMPLSNLFANAVLRAQHLHLLAAETYKEFERTYIPEDQRYTNKNS QAAFCYSETIPAPTGKDDAQQKSDMELLRFSLVLIQSWLTPVQYLSKVFTNNLVFGTS DRVFEKLKDLEEGIQALMRELEDRSPRGPQLLRPTYDKFDIHLRNEDALLKNYGLLSC FKKDLHKVETYLKVMKCRRFGESNCTI | |
| AF864- chicken GH | GSTSESPSGTAPGSTSPSGESSTAPGSTSESPSGTAPGSTSESPSGTAPGTSTPESGSASPG TSTPESGSASPGSTSESPSGTAPGSTSESPSGTAPGTSPSGESSTAPGSTSESPSGTAPGT SPSGESSTAPGSTSPSGESSTAPGSTSSTAESPGPGTSPSGESSTAPGTSPSGESSTAPGST SSTAESPGPGTSTPESGSASPGTSTPESGSASPGSTSESPSGTAPGSTSESPSGTAPGTST PESGSASPGSTSSTAESPGPGTSTPESGSASPGSTSESPSGTAPGTSPSGESSTAPGSTSS TAESPGPGTSPSGESSTAPGTSTPESGSASPGSTSSTAESPGPGSTSSTAESPGPGSTSST AESPGPGSTSSTAESPGPGTSPSGESSTAPGSTSESPSGTAPGSTSESPSGTAPGTSTPES GPXXXGASASGAPSTXXXXSESPSGTAPGSTSESPSGTAPGSTSESPSGTAPGSTSESPS GTAPGSTSESPSGTAPGSTSESPSGTAPGSTSTPESGSASPGTSPSGESSTAPGTSPSGESS TAPGSTSSTAESPGPGTSPSGESSTAPGTSTPESGSASPGSTSESPSGTAPGSTSESPSGT APGTSPSGESSTAPGSTSESPSGTAPGTSTPESGSASPGTSTPESGSASPGSTSESPSGTA PGTSTPESGSASPGSTSSTAESPGPGSTSESPSGTAPGSTSESPSGTAPGTSPSGESSTAP GSTSSTAESPGPGTSPSGESSTAPGTSTPESGSASPGTSPSGESSTAPGTSPSGESSTAPG TSPSGESSTAPGSTSSTAESPGPGSTSSTAESPGPGTSPSGESSTAPGSSPSASTGTGPGS STPSGATGSPGSSTPSGATGSPGFPAMPLSNLFANAVLRAQHLHLLAAETYKEFERTY IPEDQRYTNKNSQAAFCYSETIPAPTGKDDAQQKSDMELLRFSLVLIQSWLTPVQYLS KVFTNNLVFGTSDRVFEKLKDLEEGIQALMRELEDRSPRGPQLLRPTYDKFDIHLRNE DALLKNYGLLSCFKKDLHKVETYLKVMKCRRFGESNCTI | 714 |
| AG864- chicken GH | GASPGTSSTGSPGSSPSASTGTGPGSSPSASTGTGPGTPGSGTASSSPGSSTPSGATGSP GSNPSASTGTGPGASPGTSSTGSPGTPGSGTASSSPGSSTPSGATGSPGASPGTSSTGSP GASPGTSSTGSPGASPGTSSTGSPGTPGSGTASSSPGSSTPSGATGSPGASPGTSSTGSP GTPGSGTASSSPGSSTPSGATGSPGSNPSASTGTGPGSSPSASTGTGPGSSTPSGATGSP GSSTPSGATGSPGASPGTSSTGSPGASPGTSSTGSPGASPGTSSTGSPGTPGSGTASSSP GASPGTSSTGSPGASPGTSSTGSPGASPGTSSTGSPGSSPSASTGTGPGTPGSGTASSSP GASPGTSSTGSPGASPGTSSTGSPGASPGTSSTGSPGTPGSGTASSSPGSSTPSGATGSP GASPGTSSTGSPGTPGSGTASSSPGSSTPSGATGSPGSSTPSGATGSPGSSTPSGATGSP GSSPSASTGTGPGASPGTSSTGSPGASPGTSSTGSPGTPGSGTASSSPGSSTPSGATGSP GASPGTSSTGSPGASPGTSSTGSPGTPGSGTASSSPGSSTPSGATGSP GTPGSGTASSSPGSSTPSGATGSPGTPGSGTASSSPGSSTPSGATGSP GSSPSASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATGSP GSSTPSGATGSPGASPGTSSTGSPGFPAMPLSNLFANAVLRAQHLHLLAAETYKEFER TYIPEDQRYTNKNSQAAFCYSETIPAPTGKDDAQQKSDMELLRFSLVLIQSWLTPVQY LSKVFTNNLVFGTSDRVFEKLKDLEEGIQALMRELEDRSPRGPQLLRPTYDKFDIHLR NEDALLKNYGLLSCFKKDLHKVETYLKVMKCRRFGESNCTI | 715 |
| AM875- chicken GH | GTSTEPSEGSAPGSEPATSGSETPGSPAGSPTSTEEGSTSSTAESPGPGTSTPESGSASPG STSESPSGTAPGSTSESPSGTAPGTSTPESGSASPGTSTPESGSASPGSEPATSGSETPGT SESATPESGPGSPAGSPTSTEEGTSTEPSEGSAPGTSESATPESGPGTSTEPSEGSAPGTS TEPSEGSAPGSPAGSPTSTEEGTSTEPSEGSAPGTSTEPSEGSAPGTSESATPESGPGTSE SATPESGPGTSTEPSEGSAPGTSTEPSEGSAPGTSESATPESGPGTSTEPSEGSAPGSEPA TSGSETPGSPAGSPTSTEEGSSTPSGATGSPGTPGSGTASSSPGSSTPSGATGSPGTSTEP SEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAE SPGPGSTSESPSGTAPGTSPSGESSTAPGTPGSGTASSSPGSSTPSGATGSPGSSPSASTG TGPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGSTSSTAESPG PGTSTPESGSASPGSTSESPSGTAPGSTSTEPSEGSAPGTSTEPSEGSAPGTSTEPSEGSAP GSSTPSGATGSPGSSPSASTGTGPGASPGTSSTGSPGSEPATSGSETPGTSESATPESGP GSPAGSPTSTEEGSSTPSGATGSPGSSPSASTGTGPGASPGTSSTGSPGTSESATPESGP GTSTEPSEGSAPGTSTEPSEGSAPGFPAMPLSNLFANAVLRAQHLHLLAAETYKEFER TYIPEDQRYTNKNSQAAFCYSETIPAPTGKDDAQQKSDMELLRFSLVLIQSWLTPVQY LSKVFTNNLVFGTSDRVFEKLKDLEEGIQALMRELEDRSPRGPQLLRPTYDKFDIHLR NEDALLKNYGLLSCFKKDLHKVETYLKVMKCRRFGESNCTI | 716 |
| AE912- chicken GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE | 717 |

TABLE 35-continued

Exemplary GHXTEN comprising growth hormones and single XTEN

| GHXTEN Name* | Amino Acid Sequence | SEQ ID NO: |
|---|---|---|
| | PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMPLSNLFANAVLRAQHLHLLAAETYKEFERTYIPEDQRYTNKNSQAAFCYSETIP APTGKDDAQQKSDMELLRFSLVLIQSWLTPVQYLSKVFTNNLVFGTSDRVFEKLKDL EEGIQALMRELEDRSPRGPQLLRPTYDKFDIHLRNEDALLKNYGLLSCFKKDLHKVE TYLKVMKCRRFGESNCTI | |
| AM923-chicken GH | MAEPAGSPTSTEEGASPGTSSTGSPGSSTPSGATGSPGSSTPSGATGSPGTSTE PSEGSAPGSEPATSGSETPGSPAGSPTSTEEGSTSSTAESPGPGTSTPESGSASP GSTSESPSGTAPGSTSESPSGTAPGTSTPESGSASPGTSTPESGSASPGSEPATS GSETPGTSESATPESGPGSPAGSPTSTEEGTSTEPSEGSAPGTSESATPESGPGT STEPSEGSAPGTSTEPSEGSAPGSPAGSPTSTEEGTSTEPSEGSAPGTSTEPSEG SAPGTSESATPESGPGTSESATPESGPGTSTEPSEGSAPGTSTEPSEGSAPGTSE SATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPAT SGSETPGSPAGSPTSTEEGSPAGSPTSTEEGTSTEPSEGSAPGASASGAPSTGGT SESATPESGPGSPAGSPTSTEEGSPAGSPTSTEEGSTSSTAESPGPGSTSESPSGT APGTSSPGESSTAPGTPGSGTASSSPGSSTPSGATGSPGSSPSASTGTGPGSEPA TSGSETPGTSESATPESGPGSEPATSGSETPGSTSSTAESPGPGSTSSTAESPGP GTSSPGESSTAPGSEPATSGSETPGSEPATSGSETPGTSTEPSEGSAPGSTSSTA ESPGPGTSTPESGSASPGSTSESPSGTAPGTSTEPSEGSAPGTSTEPSEGSAPGT STEPSEGSAPGSSTPSGATGSPGSSPSASTGTGPGASPGTSSTGSPGSEPATSGS ETPGTSESATPESGPGSPAGSPTSTEEGSSTPSGATGSPGSSPSASTGTGPGASP GTSSTGSPGTSESATPESGPGTSTEPSEGSAPGTSTEPSEGSAPGFPAMPLSNLF ANAVLRAQHLHLLAAETYKEFERTYIPEDQRYTNKNSQAAFCYSETIPAPTG KDDAQQKSDMELLRFSLVLIQSWLTPVQYLSKVFTNNLVFGTSDRVFEKLK DLEEGIQALMRELEDRSPRGPQLLRPTYDKFDIHLRNEDALLKNYGLLSCFK KDLHKVETYLKVMKCRRFGESNCTI | 718 |
| AD576-horse GH | GSSESGSSEGGPGSGGEPSESGSSGSSESGSSEGGPGSSESGSSEGGPGSSESGS SEGGPGSSESGSSEGGPGSSESGSSEGGPGESPGGSSGSESGSEGSSGPGESSGS SESGSSEGGPGSSESGSSEGGPGSSESGSSEGGPGSSGGEPSESGSSGESPGGSSG SESGESPGGSSGSESGSGGEPSESGSSGSSESGSSEGGPGSSGGEPSESGSSGSGG EPSESGSSGESSGPGESSGESPGGSSGSESGSSGGEPSESGSSGSGGEPSESGSSGS SGSGGEPSESGSSGSSESGSSEGGPGESPGGSSGSESGESPGGSSGSESGESPGG SSGSESGESPGGSSGSESGESPGGSSGSESGSSESGGPGSSGGEPSESGSSG SEGSSGPGESSGSSESGSSEGGPGSGGEPSESGSSGSSSESGSSEGGPGSGGEPSE SGSSGESPGGSSGSSESGESPGGSSGSESGSSESGGPGSGGEPSESGSSGSS ESGSSEGGPGSGGEPSESGSSGSGGEPSESGSSGESPGGSSGSESGSEGSSGPGE SSGSSESGSSEGGPGSEGSSGPGESSGFPAMPLSSLFANAVLRAQHLHQLAAD TYKEFERAYIPEGQRYSIQNAQAAFCFSETIPAPTGKDEAQQRSDMELLRFSL LLIQSWLGPVQLLSRVFTNSLVFGTSDRVYEKLRDLEEGIQALMRELEDGSPR AGQILKQTYDKFDTNLRSDDALLKNYGLLSCFKKDLHKAETYLRV MKCRRFVESSCAF | 719 |
| AE576-horse GH | GSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGS PAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSE SATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESA TPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATP ESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTST EEGTSESATPESGPGTSTEPSEGSAPGFPAMPLSSLFANAVLRAQHLHQLAAD TYKEFERAYIPEGQRYSIQNAQAAFCFSETIPAPTGKDEAQQRSDMELLRFSL LLIQSWLGPVQLLSRVFTNSLVFGTSDRVYEKLRDLEEGIQALMRELEDGSPR AGQILKQTYDKFDTNLRSDDALLKNYGLLSCFKKDLHKAETYLRV MKCRRFVESSCAF | 720 |
| AF576-horse GH | GSTSSTAESPGPGSTSSTAESPGPGSTSESPSGTAPGSTSSTAESPGPGSTSSTAE SPGPGTSTPESGSASPGSTSESPSGTAPGSTSPGESSTAPGSTSESPSGTAPGSTS ESPSGTAPGSTSESPSGTAPGSTSESPSGTAPGSTSPGESSTAP GSTSESPSGTAPGSTSESPSGTAPGSTSESPSGTAPGSTSPESGSASPGSTSESPS GTAPGSTPESGSASPGSTSSTAESPGPGSTSSTAESPGPGTSTPESGSASPGSTS TPESGSASPGSTSESPSGTAPGSTPESGSASPGSTPESGSASPGSTSESPSGTA PGSTSESPSGTAPGSTSESPSGTAPGSTSSTAESPGPGTSTPESGSASPGTSTPES | 721 |

TABLE 35-continued

Exemplary GHXTEN comprising growth hormones and single XTEN

| GHXTEN Name* | Amino Acid Sequence | SEQ ID NO: |
|---|---|---|
| | GSASPGSTSESPSGTAPGSTSESPSGTAPGTSTPESGSASPGSTSESPSGTAPGS<br>TSESPSGTAPGTSTPESGSASPGTSPSGESSTAPGSTSSTAESPGPGTSPSGESST<br>APGSTSSTAESPGPGTSTPESGSASPGSTSESPSGTAPGSTSSTAESPGPGTSTPE<br>SGSASPGTSTPESGSASPGFPAMPLSSLFANAVLRAQHLHQLAADTYKEFERA<br>YIPEGQRYSIQNAQAAFCFSETIPAPTGKDEAQQRSDMELLRFSLLLIQSWLGP<br>VQLLSRVFTNSLVFGTSDRVYEKLRDEEGIQALMRELEDGSPRAGQILKQT<br>YDKFDTNLRSDDALLKNYGLLSCFKKDLHKAETYLRVMKCRRFVESSCAF | |
| AE624-<br>horse GH | MAEPAGSPTSTEEGTPGSGTASSSPGSSTPSGATGSPGASPGTSSTGSPGSPAG<br>SPTSTEEGTSESATPESGPGTSTEPSEGSAPGSPAGSPTSTEEGTSTEPSEGSAP<br>GTSTEPSEGSAPGTSESATPESGPGSEPATSGSETPGSEPATSGSETPGSPAGSP<br>TSTEEGTSESATPESGPGTSTEPSEGSAPGTSTEPSEGSAPGSPAGSPTSTEEGT<br>STEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSE<br>SATPESGPGSPAGSPTSTEEGTSESATPESGPGSEPATSGSETPGTSESATPESG<br>PGTSTEPSEGSAPGTSTEPSEGSAPGTSTEPSEGSAPGTSTEPSEGSAPGTSTEP<br>SEGSAPGTSTEPSEGSAPGSPAGSPTSTEEGTSTEPSEGSAPGTSESATPESGPG<br>SEPATSGSETPGTSESATPESGPGSEPATSGSETPGTSESATPESGPGTSTEPSE<br>GSAPGTSESATPESGPGSPAGSPTSTEEGSPAGSPTSTEEGSPAGSPTSTEEGTS<br>ESATPESGPGTSTEPSEGSAPGFPAMPLSSLFANAVLRAQHLHQLAADTYKEF<br>ERAYIPEGQRYSIQNAQAAFCFSETIPAPTGKDEAQQRSDMELLRFSLLLIQS<br>WLGPVQLLSRVFTNSLVFGTSDRVYEKLRDEEGIQALMRELEDGSPRAGQI<br>LKQTYDKFDTNLRSDDALLKNYGLLSCFKKDLHKAETYLRV<br>MKCRRFVESSCAF | 722 |
| AD836-<br>horse GH | GSSESGSSEGGPGSSESGSSEGGPGESPGGSSGSESGSGGEPSESGSSGESPGGS<br>SGSESGESPGGSSGSESGSSEGGPGSSESGSSEGGPGSSSESGSSEGGPSE<br>SPGGSSGSESGESPGGSSGSESGESPGGSSGSESGSSEGGSSSEGGPGSSESGSSE<br>GGPGSSESGSSEGGPGSSESGSSEGGPGSSESGSSEGGPGSG<br>GEPSESGSSGESPGGSSGSESGESPGGSSGSESGSGGEPSESGSSGEGSSGPGE<br>SSGSSESGSSEGGPGSSGGEPSESGSSGSEGSSGPGESSGSSESGSSEGGPGSGGE<br>PSESGSSGESPGGSSGSESGSGGEPSESGSSGSGGEPSESGSSGSESGSSEGGP<br>GSGGEPSESGSSGSGGEPSESGSSGSEGSSGPGESSGESPGGSSGSESGSEGSSG<br>PGESSGEGSSGPGESSGSGGEPSESGSSGSSESGSSEGGPGSSESGSSEGGPGE<br>SPGGSSGSESGSGGEPSESGSSGSEGSSGPGESSGESPGGSSGSESGSEGSSGPG<br>SSSESGSSEGGPGSGGEPSESGSSGSEGSSGPGESSGSEGSSGPGESSGEGSSGP<br>GESSGSGGEPSESGSSGSGGEPSESGSSGESPGGSSGSESGESPGGSSGSESGSG<br>GEPSESGSSGSEGSSGPGESSGESPGGSSGSESGSSESGSSEGGPGSSESGSSEG<br>GPGSSESGSSEGGPGSSGGEPSESGSSGSSESGSSEGGPGESPGGSSGSESGGG<br>EPSESGSSGSSESGSSEGGPGESPGESPGGSSGSESGSSGGGEPSESGSSGESPGGSSGSE<br>SGSGGEPSESGSSGFPAMPLSSLFANAVLRAQHLHQLAADTYKEFERAYIPEG<br>QRYSIQNAQAAFCFSETIPAPTGKDEAQQRSDMELLRFSLLLIQSWLGPVQLL<br>SRVFTNSLVFGTSDRVYEKLRDEEGIQALMRELEDGSPRAGQILKQTYDKF<br>DTNLRSDDALLKNYGLLSCFKKDLHKAETYLRVMKCRRFVESSCAF | 723 |
| AE864-<br>horse GH | GSPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPGS<br>PAGSPTSTEEGTSESATPESGPGTSTEPSEGSAPGTSTEPSEGSAPGSPAGSPTS<br>TEEGTSTEPSEGSAPGTSTEPSEGSAPGTSESATPESGPGTSTEPSEGSAPGTSE<br>SATPESGPGSEPATSGSETPGTSTEPSEGSAPGTSTEPSEGSAPGTSESATPESG<br>PGTSESATPESGPGSPAGSPTSTEEGTSESATPESGPGSEPATSGSETPGTSESA<br>TPESGPGTSTEPSEGSAPGTSTEPSEGSAPGTSTEPSEGSAPGTSTEPSEGSAPG<br>TSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTS<br>TEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEE<br>GTSESATPESGPGSEPATSGSETPGTSESATPESGPGSPAGSPTSTEEGSPAGSP<br>TSTEEGTSTEPSEGSAPGTSESATPESGPGTSESATPESGPGTSESATPESGPGS<br>EPATSGSETPGSEPATSGSETPGSPAGSPTSTEEGTSTEPSEGSAPGTSTEPSEG<br>SAPGSEPATSGSETPGTSESATPESGPGTSTEPSEGSAPGFPAMPLSSLFANAV<br>LRAQHLHQLAADTYKEFERAYIPEGQRYSIQNAQAAFCFSETIPAPTGKDEA<br>QQRSDMELLRFSLLLIQSWLGPVQLLSRVFTNSLVFGTSDRVYEKLRDEEGI<br>QALMRELEDGSPRAGQILKQTYDKFDTNLRSDDALLKNYGLLSCFKKDLHK<br>AETYLRV MKCRRFVESSCAF | 724 |
| AF864-<br>horse GH | GSTSESPSGTAPGTSPSGESSTAPGSTSESPSGTAPGSTSESPSGTAPGTSTPESG<br>SASPGTSTPESGSASPGSTSESPSGTAPGSTSESPSGTAPGTSPSGESSTAPGSTS<br>ESPSGTAPGTSPSGESSTAPGTSPSGESSTAPGSTSSTAESPGPGTSPSGESSTAP<br>GTSPSGESSTAPGSTSSTAESPGPGTSTPESGSASPGTSTPESGSASPGSTSESPS<br>GTAPGSTSESPSGTAPGTSTPESGSASPGSTSSTAESPGPGTSTPESGSASPGST<br>SESPSGTAPGTSPSGESSTAPGSTSSTAESPGPGTSPSGESSTAPGTSTPESGSAS<br>PGSTSSTAESPGPGTSSTAESPGPGTSSTAESPGPGTSSTAESPGPGTSPSGE<br>SSTAPGSTSESPSGTAPGSTSESPSGTAPGTSTPESGPXXXGASASGAPSTXXX | 725 |

TABLE 35-continued

Exemplary GHXTEN comprising growth hormones and single XTEN

| GHXTEN Name* | Amino Acid Sequence | SEQ ID NO: |
|---|---|---|
| | XSESPSGTAPGSTSESPSGTAPGSTSESPSGTAPGSTSESPSGT APGSTSESPSGTAPGTSTPESGSASPGTSPSGESSTAPGTSPSGESSTAPGSTSST AESPGPGTSPSGESSTAPGSTSTPESGSASPGSTSESPSGTAPG TSPSGESSTAPGSTSESPSGTAPGTSTPESGSASPGTSTPESGSASPGSTSESPSG TAPGTSTPESGSASPGSTSSTAESPGPGSTSESPSGTAPGSTSESPSGTAPGTSPS GESSTAPGSTSSTAESPGPGTSPSGESSTAPGTSTPESGSASPGTSPSGESSTAP GTSPSGESSTAPGTSPSGESSTAPGSTSSTAESPGPGSTSSTAESPGPGTSPSGES STAPGSSPSASTGTGPGSSTPSGATGSPGSSTPSGATGSPGFPAMPLSSLFANA VLRAQHLHQLAADTYKEFERAYIPEGQRYSIQNAQAAFCFSETIPAPTGKDE AQQRSDMELLRFSLLLIQSWLGPVQLLSRVFTNSLVFGTSDRVYEKLRDLEE GIQALMRELEDGSPRAGQILKQTYDKFDTNLRSDDALLKNYGLLSCFKKDLH KAETYLRV MKCRRFVESSCAF | |
| AG864-horse GH | GASPGTSSTGSPGSSPSASTGTGPGSSPSASTGTGPGTPGSGTASSSPGSSTPSG ATGSPGSNPSASTGTGPGASPGTSSTGSPGTPGSGTASSSPGSSTPSGATGSPG TPGSGTASSSPGASPGTSSTGSPGASPGTSSTGSPGTPGSGTASSSPGSSTPSGA TGSPGASPGTSSTGSPGTPGSGTASSSPGSSTPSGATGSPGSNPSASTGTGPGSS PSASTGTGPGSSTPSGATGSPGSSTPSGATGSPGASPGTSSTGSPGASPGTSSTG SPGASPGTSSTGSPGTPGSGTASSSPGASPGTSSTGSPGASPGTSSTGSPGASPG TSSTGSPGSSPSASTGTGPGTPGSGTASSSPGASPGTSSTGSPGASPGTSSTGSP GASPGTSSTGSPGSSTPSGATGSPGSSTPSGATGSPGASPGTSSTGSPGTPGSGT ASSSPGSSTPSGATGSPGSSTPSGATGSPGSSTPSGATGSPGSSPSASTGTGPGA SPGTSSTGSPGASPGTSSTGSPGTPGSGTASSSPGASPGTSSTGSPGASPGTSST GSPGASPGTSSTGSPGASPGTSSTGSPGTPGSGTASSSPGSSTPSGATGSPGTPG SGTASSSPGSSTPSGATGSPGTPGSGTASSSPGSSTPSGATGSPGSSTPSGATGS PGSSPSASTGTGPGSSPSASTGTGPGASPGTSSTGSPGTPGSGTASSSPGSSTPS GATGSPGSSPSASTGTGPGSSPSASTGTGPGASPGTSSTGSPGASPGTSSTGSP GSSTPSGATGSPGSSPSASTGTGPGASPGTSSTGSPGSSPSASTGTGPGTPGSGT ASSSPGSSTPSGATGSPGSSTPSGATGSPGASPGTSSTGSPGFPAMPLSSLFAN AVLRAQHLHQLAADTYKEFERAYIPEGQRYSIQNAQAAFCFSETIPAPTGKD EAQQRSDMELLRFSLLLIQSWLGPVQLLSRVFTNSLVFGTSDRVYEKLRDLE EGIQALMRELEDGSPRAGQILKQTYDKFDTNLRSDDALLKNYGLLSCFKKDL HKAETYLRV MKCRRFVESSCAF | 726 |
| AM875-horse GH | GTSTEPSEGSAPGSEPATSGSETPGSPAGSPTSTEEGSTSSTAESPGPGTSTPES GSASPGSTSESPSGTAPGSTSESPSGTAPGTSTPESGSASPGTSPSGESSAPGS EPATSGSETPGTSESATPESGPGSPAGSPTSTEEGTSTEPSEGSAPGTSESATPE SGPGTSTEPSEGSAPGTSTEPSEGSAPGSPAGSPTSTEEGTSTEPSEGSAPGTSST EPSEGSAPGTSESATPESGPGTSESATPESGPGTSTEPSEGSAPGTSTEPSEGSA PGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAPG SEPATSGSETPGSPAGSPTSTEEGSPAGSPTSTEEGTSTEPSEGSAPGASASGAP STGGTSESATPESGPGSPAGSPTSTEEGSPAGSPTSTEEGSTSSTAESPGPGSTS ESPSGTAPGTSPSGESSTAPGTPGSGTASSSPGSSTPSGATGSPGSSPSASTGTG PGSEPATSGSETPGTSESATPESGPGSEPATSGSETPGSTSSTAESPGPGSTSST AESPGPGTSPSGESSTAPGSEPATSGSETPGSEPATSGSETPGTSTEPSEGSAPG STSSTAESPGPGTSTPESGSASPGSTSESPSGTAPGTSTEPSEGSAPGTSTEPSEG SAPGTSTEPSEGSAPGSSTPSGATGSPGSSPSASTGTGPGASPGTSSTGSPGSEP ATSGSETPGTSESATPESGPGSPAGSPTSTEEGSSTPSGATGSPGSSPSASTGTG PGASPGTSSTGSPGTSESATPESGPGTSTEPSEGSAPGTSTEPSEGSAPGFPAMP LSSLFANAVLRAQHLHQLAADTYKEFERAYIPEGQRYSIQNAQAAFCFSETIP APTGKDEAQQRSDMELLRFSLLLIQSWLGPVQLLSRVFTNSLVFGTSDRVYE KLRDLEEGIQALMRELEDGSPRAGQILKQTYDKFDTNLRSDDALLKNYGLLS CFKKDLHKAETYLRV MKCRRFVESSCAF | 727 |
| AE912-horse GH | MAEPAGSPTSTEEGTPGSGTASSSPGSSTPSGATGSPGASPGTSSTGSPGSPAG SPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGT STEPSEGSAPGTSTEPSEGSAPGTSESATPESGPGTSTEPSEGSAPGTSESATPE SGPGSEPATSGSETPGTSTEPSEGSAPGTSTEPSEGSAPGTSESATPESGPGTSE SATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATPESGPG SEPATSGSETPGTSESATPESGPGSEPATSGSETPGTSESATPESGPGTSTEPSE GSAPGTSESATPESGPGSPAGSPTSTEEGSPAGSPTSTEEGSPAGSPTSTEEGTS ESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEE GTSTEPSEGSAPGTSESATPESGPGTSESATPESGPGTSESATPESGPGSEPATS GSETPGSEPATSGSETPGSPAGSPTSTEEGTSTEPSEGSAPGTSTEPSEGSAPGS EPATSGSETPGTSESATPESGPGTSTEPSEGSAPGFPAMPLSSLFANAVLRAQH LHQLAADTYKEFERAYIPEGQRYSIQNAQAAFCFSETIPAPTGKDEAQQRSD MELLRFSLLLIQSWLGPVQLLSRVFTNSLVFGTSDRVYEKLRDLEEGIQALMR | 728 |

TABLE 35-continued

Exemplary GHXTEN comprising growth hormones and single XTEN

| GHXTEN Name* | Amino Acid Sequence | SEQ ID NO: |
|---|---|---|
| | ELEDGSPRAGQILKQTYDKFDTNLRSDDALLKNYGLLSCFKKDLHKAETYLR V MKCRRFVESSCAF | |
| AM923- horse GH | MAEPAGSPTSTEEGASPGTSSTGSPGSSTPSGATGSPGSSTPSGATGSPGTSTE PSEGSAPGSEPATSGSETPGSPAGSPTSTEEGSTSSTAESPGPGTSTPESGSASP GSTSESPSGTAPGSTSESPSGTAPGTSTPESGSASPGTSTPESGSASPGSEPATS GSETPGTSESATPESGPGSPAGSPTSTEEGTSTEPSEGSAPGTSESATPESGPGT STEPSEGSAPGTSTEPSEGSAPGSPAGSPTSTEEGTSTEPSEGSAPGTSTEPSEG SAPGTSESATPESGPGTSESATPESGPGTSTEPSEGSAPGTSTEPSEGSAPGTSE SATPESGPGTSTEPSEGSAPGSEPATSGSETPGSPAGSPTSTEEGSSTPSGATGS PGTPGSGTASSSPGSSTPSGATGSPGTSTEPSEGSAPGTSTEPSEGSAPGSEPAT SGSETPGSPAGSPTSTEEGSPAGSPTSTEEGTSTEPSEGSAPGASASGAPSTGGT SESATPESGPGSPAGSPTSTEEGSPAGSPTSTEEGTSSTAESPGPGSTSESPSGT APGTSPSGESSTAPGTPGSGTASSSPGSSTPSGATGSPGSSPSASTGTGPGSEPA TSGSETPGTSESATPESGPGSEPATSGSETPGSTSSTAESPGPGSTSSTAESPGP GTSPSGESSTAPGSEPATSGSETPGSEPATSGSETPGTSTEPSEGSAPGSTSSTA ESPGPGTSTPESGSASPGSTSESPSGTAPGTSTEPSEGSAPGTSTEPSEGSAPGT STEPSEGSAPGSSTPSGATGSPGSSPSASTGTGPGASPGTSSTGSPGSEPATSGS ETPGTSESATPESGPGSPAGSPTSTEEGSSTPSGATGSPGSSPSASTGTGPGASP GTSSTGSPGTSESATPESGPGTSTEPSEGSAPGTSTEPSEGSAPGFPAMPLSSLF ANAVLRAQHLHQLAADTYKEFERAYIPEGQRYSIQNAQAAFCFSETIPAPTG KDEAQQRSDMELLRFSLLLIQSWLGPVQLLSRVFTNSLVFGTSDRVYEKLRD LEEGIQALMRELEDGSPRAGQILKQTYDKFDTNLRSDDALLKNYGLLSCFKK DLHKAETYLRV MKCRRFVESSCAF | 729 |
| AD576- turkey GH | GSSESGSSEGGPGSGGEPSESGSSGSSESGSSEGGPGSSESGSSEGGPGSSESGSSEGGP GSSESGSSEGGPGSSESGSSEGGPGSPGGSSGSESGSSGPGESSESGSSEGGP GSSESGSSEGGPGSSESGSSEGGPGSGGEPSESGSSGESPGGSSGSESGESPGGSSGSES GSGGEPSESGSSGSSESGSSEGGPGSGGEPSESGSSGSGGEPSESGSSGSEGSSGPGESS GESPGGSSGSESGSGGEPSESGSSGSGGEPSESGSSGSGGEPSESGSSGSSESGSSEGGP GESPGGSSGSESGESPGGSSGSESGESPGGSSGSESGESPGGSSGSES GSSESGSSEGGPGSGGEPSESGSSGSEGSSGPGESSSESGSSEGGPGSGGEPSESGSS GSSESGSSEGGPGSGGEPSESGSSGESPGGSSGSESGESPGGSSGSESGSSESGSSEGGP GSGGEPSESGSSGSSESGSSEGGPGSGGEPSESGSSGSGGEPSESGSSGPGGSSGSES GSEGSSGPGESSGSSESGSSEGGPGSEGSSGPGESSGFPTMPLSNLFTNAVLRAQHLHL LAAETYKEFERTYIPEDQRYTNKNSQAAFCYSETIPAPTGKDDAQQKSDMELLRFSLV LIQSWLTPMQYLSKVFTNNLVFGTSDRVFEKLKDLEEGIQALMRELEDRSPRGPQLLR PTYDRFDIHLRSEDALLKNYGLLSCFKKDLHKVETYLKVMKCRRFGESNCNI | 730 |
| AE576- turkey GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGFPTMPLSNLFTNAVLRAQHLHLLAAETYKEF ERTYIPEDQRYTNKNSQAAFCYSETIPAPTGKDDAQQKSDMELLRFSLVLIQSWLTPM QYLSKVFTNNLVFGTSDRVFEKLKDLEEGIQALMRELEDRSPRGPQLLRPTYDRFDIH LRSEDALLKNYGLLSCFKKDLHKVETYLKVMKCRRFGESNCNI | 731 |
| AF576- turkey GH | GSTSSTAESPGPGSTSSTAESPGPGSTSESPSGTAPGSTSSTAESPGPGSTSSTAESPGPG TSTPESGSASPGSTSESPSGTAPGTSPSGESSTAPGSTSESPSGTAPGSTSESPSGTAPGT SPSGESSTAPGSTSESPSGTAPGSTSESPSGTAPGTSPSGESSTAPGSTSESPSGTAPGST SESPSGTAPGSTSESPSGTAPGTSTPESGSASPGSTSTPESGSASPGSTSESPSGTAPGSTS STAESPGPGSTSSTAESPGPGSTSTPESGSASPGSTSTPESGSASPGSTSESPSGTAPGTSTP ESGSASPGTSTPESGSASPGSTSESPSGTAPGSTSESPSGTAPGSTSESPSGTAPGSTSST AESPGPGSTSTPESGSASPGSTSTPESGSASPGSTSESPSGTAPGSTSESPSGTAPGTSTPES GSASPGSTSESPSGTAPGSTSESPSGTAPGTSTPESGSASPGSPSGESSTAPGSTSSTAE SPGPGTSPSGESSTAPGSTSSTAESPGPGSTSTPESGSASPGSTSESPSGTAPGSTSSTAES PGPGTSTPESGSASPGSTSPESGSASPGFPTMPLSNLFTNAVLRAQHLHLLAAETYKEF ERTYIPEDQRYTNKNSQAAFCYSETIPAPTGKDDAQQKSDMELLRFSLVLIQSWLTPM QYLSKVFTNNLVFGTSDRVFEKLKDLEEGIQALMRELEDRSPRGPQLLRPTYDRFDIH LRSEDALLKNYGLLSCFKKDLHKVETYLKVMKCRRFGESNCNI | 732 |
| AE624- turkey GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE | 733 |

TABLE 35-continued

Exemplary GHXTEN comprising growth hormones and single XTEN

| GHXTEN Name* | Amino Acid Sequence | SEQ ID NO: |
|---|---|---|
| | PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGSEPATSGSETPGSTEPS EGSAPGTSESATPESGPGSPAGSPTSTEEGSPAGSPTSTEEGSPAGSPTSTEEGTSESATP ESGPGTSTEPSEGSAPGFPTMPLSNLFTNAVLRAQHLHLLAAETYKEFERTYIPEDQR YTNKNSQAAFCYSETIPAPTGKDDAQQKSDMELLRFSLVLIQSWLTPMQYLSKVFTN NLVFGTSDRVFEKLKDLEEGIQALMRELEDRSPRGPQLLRPTYDRFDIHLRSEDALLK NYGLLSCFKKDLHKVETYLKVMKCRRFGESNCNI | |
| AD836-turkey GH | GSSESGSSEGGPGSSESGSSEGGPGESPGGSSGSESGSGGEPSESGSSGESPGGSSGSES GESPGGSSGSESGSSESGSSEGGPGSSESGSSEGGPGSSESGSSEGGPGESPGGSSGSES GESPGGSSGSESGESPGGSSGSESGSSESGGPGSSESGSSEGGPGSSESGSSEGGP GSSESGSSEGGPGSSESGSSEGGPGSSESGSSEGGPGSGGEPSESGSSGESPGGSSGSES GESPGGSSGSESGSGGEPSESGSSGSEGSSGPGESSGSSESGSSEGGPGSGGEPSESGSS GSEGSSGPGESSGSSESGSSEGGPGSGGEPSESGSSGESPGGSSGSESGSGGEPSESGSS GSGGEPSESGSSGSSEGGPGSGGEPSESGSSGSGGPGESSGSSESGSSEGGPGSGGEPGESS GESPGGSSGSESGSEGSSGPGESSGSEGSSGPGESSGSGGEPSESGSSGSSESGSSEGGP GSSSESGSSEGGPGESPGGSSGSESGSGGEPSESGSSGSEGSSGPGESSGESPGGSSGSES GSEGSSGPGSSESGSSEGGPGSGGEPSESGSSGSEGSSGPGESSGSEGSSGPGESSGSEG SSGPGESSGSGGEPSESGSSGGEPSESGSSGESPGGSSGSESGESPGGSSGSESGSSG EPSESGSSGSEGSSGPGESSGESPGGSSGSESGSSESGSSEGGPGSSESGSSEGGPGSSSES GSSEGGPGSGGEPSESGSSGSSESGSSEGGPGESPGGSSGSESGSGGEPSESGSSGSSES GSSEGGPGESPGGSSGSESGSGGEPSESGSSGESPGGSSGSESGSGGEPSESGSSGFPTM PLSNLFTNAVLRAQHLHLLAAETYKEFERTYIPEDQRYTNKNSQAAFCYSETIPAPTG KDDAQQKSDMELLRFSLVLIQSWLTPMQYLSKVFTNNLVFGTSDRVFEKLKDLEEGI QALMRELEDRSPRGPQLLRPTYDRFDIHLRSEDALLKNYGLLSCFKKDLHKVETYLK VMKCRRFGESNCNI | 734 |
| AE864-turkey GH | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESGSPAGSPTSTEEGTSESES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAP GTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESATPESGPGT STEPSEGSAPGFPTMPLSNLFTNAVLRAQHLHLLAAETYKEFERTYIPEDQRYTNKNS QAAFCYSETIPAPTGKDDAQQKSDMELLRFSLVLIQSWLTPMQYLSKVFTNNLVFGT SDRVFEKLKDLEEGIQALMRELEDRSPRGPQLLRPTYDRFDIHLRSEDALLKNYGLLS CFKKDLHKVETYLKVMKCRRFGESNCNI | 735 |
| AF864-turkey GH | GSTSESPSGTAPGTSPSGESSTAPGSTSESPSGTAPGSTSESPSGTAPGTSTPESGSASPG TSTPESGSASPGSTSESPSGTAPGSTSESPSGTAPGTSPSGESSTAPGSTSESPSGTAPGT SPSGESSTAPGTSPSGESSTAPGSTSSTAESPGPGTSPSGESSTAPGTSPSGESSTAPGST SSTAESPGPGTSTPESGSASPGTSTPESGSASPGSTSESPSGTAPGSTSESPSGTAPGTST PESGSASPGSTSSTAESPGPGTSTPESGSASPGSTSESPSGTAPGSTSESPSGTAPGSTSS TAESPGPGTSPSGESSTAPGSTSSTAESPGPGTSTPESGSASPGSTSSTAESPGPGTSSST AESPGPGSTSSTAESPGPGTSPSGESSTAPGSTSESPSGTAPGSTSESPSGTAPGTSTPES GPXXXGASASGAPSTXXXXSESPSGTAPGSTSESPSGTAPGSTSESPSGTAPGSTSESPS GTAPGSTSESPSGTAPGSTSESPSGTAPGTSTPESGSASPGTSPSGESSTAPGTSPSGESS TAPGSTSSTAESPGPGTSPSGESSTAPGTSTPESGSASPGSTSESPSGTAPGSTSESPSGT APGTSPSGESSTAPGTSESPSGTAPGTSTPESGSASPGTSPSGESSTAPGSTSESPSGTA PGTSTPESGSASPGSTSSTAESPGPGSTSESPSGTAPGSTSESPSGTAPGTSPSGESSTAP GSTSSTAESPGPGTSPSGESSTAPGTSTPESGSASPGTSPSGESSTAPGTSPSGESSTAPG TSPSGESSTAPGSTSSTAESPGPGSTSSTAESPGPGTSPSGESSTAPGSSPSASTGTPGPS STPSGATGSPGSSTPSGATGSPGFPTMPLSNLFTNAVLRAQHLHLLAAETYKEFERTYI PEDQRYTNKNSQAAFCYSETIPAPTGKDDAQQKSDMELLRFSLVLIQSWLTPMQYLS KVFTNNLVFGTSDRVFEKLKDLEEGIQALMRELEDRSPRGPQLLRPTYDRFDIHLRSE DALLKNYGLLSCFKKDLHKVETYLKVMKCRRFGESNCNI | 736 |
| AG864-turkey GH | GASPGTSSTGSPGSSPSASTGTPGPSSPSASTGTPGPGTPGSGTASSSPGSSTPSGATGSP GSNPSASTGTPGPASPGTSSTGSPGPTPGSGTASSSPGSSTPSGATGSPGTPGSGTASSSP GASPGTSSTGSPGASPGTSSTGSPGPTPGSGTASSSPGSSTPSGATGSPGASPGTSSTGSP GTPGSGTASSSPGSSTPSGATGSPGSNPSASTGTPGPSASTGTPGPSASTGTPGSGTASSSP GSSTPSGATGSPGASPGTSSTGSPGASPGTSSTGSPGASPGTSSTGSPGSGTASSSP GASPGTSSTGSPGASPGTSSTGSPGASPGTSSTGSPGSSPSASTGTPGPTPGSGTASSSP GASPGTSSTGSPGASPGTSSTGSPGASPGTSSTGSPGSSTPSGATGSPGSSTPSGATGSP GASPGTSSTGSPGTPGSGTASSSPGSSTPSGATGSPGSSTPSGATGSPGSSTPSGATGSP GSSPSASTGTPGPGASPGTSSTGSPGASPGTSSTGSPGTPGSGTASSSPGASPGTSSTGSP | 737 |

TABLE 35-continued

Exemplary GHXTEN comprising growth hormones and single XTEN

| GHXTEN Name* | Amino Acid Sequence | SEQ ID NO: |
|---|---|---|
| | GASPGTSSTGSPGASPGTSSTGSPGASPGTSSTGSPGTPGSGTASSSPGSSTPSGATGSP GTPGSGTASSSPGSSTPSGATGSPGTPGSGTASSSPGSSTPSGATGSPGSSPSASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGATGSP GSSPSASTGTGPGASPGTSSTGSPGSSPSASTGTGPGTPGSGTASSSPGSSTPSGATGSP GSSTPSGATGSPGASPGTSSTGSPGFPTMPLSNLFTNAVLRAQHLHLLAAETYKEFER TYIPEDQRYTNKNSQAAFCYSETIPAPTGKDDAQQKSDMELLRFSLVLIQSWLTPMQ YLSKVFTNNLVFGTSDRVFEKLKDLEEGIQALMRELEDRSPRGPQLLRPTYDRFDIHL RSEDALLKNYGLLSCFKKDLHKVETYLKVMKCRRFGESNCNI | |
| AM875-turkey GH | GTSTEPSEGSAPGSEPATSGSETPGSPAGSPTSTEEGSTSSTAESPGPGTSTPESGSASPG STSESPSGTAPGSTSESPSGTAPGTSTPESGSASPGTSTPESGSASPGSEPATSGSETPGT SESATPESGPGSPAGSPTSTEEGTSTEPSEGSAPGTSESATPESGPGTSTEPSEGSAPGTS TEPSEGSAPGSPAGSPTSTEEGTSTEPSEGSAPGTSTEPSEGSAPGTSESATPESGPGTSE SATPESGPGTSTEPSEGSAPGTSTEPSEGSAPGTSESATPESGPGTSTEPSEGSAPGSEPA TSGSETPGSPAGSPTSTEEGSSTPSGATGSPGTPGSGTASSSPGSSTPSGATGSPGTSTEP SEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAE SPGPGSTSESPSGTAPGTSPSGESSTAPGTPGSGTASSSPGSSTPSGATGSPGSSPSASTG TGPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGTSSTAESPG PGTSTPESGSASPGTSSESPSGTAPGTSTEPSEGSAPGTSTEPSEGSAPGTSTEPSEGSAP GSSTPSGATGSPGSSPSASTGTGPGASPGTSSTGSPGSEPATSGSETPGTSESATPESGP GSPAGSPTSTEEGSSTPSGATGSPGSSPSASTGTGPGASPGTSSTGSPGTSESATPESGP GTSTEPSEGSAPGTSTEPSEGSAPGFPTMPLSNLFTNAVLRAQHLHLLAAETYKEFERT YIPEDQRYTNKNSQAAFCYSETIPAPTGKDDAQQKSDMELLRFSLVLIQSWLTPMQY LSKVFTNNLVFGTSDRVFEKLKDLEEGIQALMRELEDRSPRGPQLLRPTYDRFDIHLR SEDALLKNYGLLSCFKKDLHKVETYLKVMKCRRFGESNCNI | 738 |
| AE912-turkey GH | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGP TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPTMPLSNLFTNAVLRAQHLHLLAAETYKEFERTYIPEDQRYTNKNSQAAFCYSETIP APTGKDDAQQKSDMELLRFSLVLIQSWLTPMQYLSKVFTNNLVFGTSDRVFEKLKDL EEGIQALMRELEDRSPRGPQLLRPTYDRFDIHLRSEDALLKNYGLLSCFKKDLHKVET YLKVMKCRRFGESNCNI | 739 |
| AM923-turkey GH | MAEPAGSPTSTEEGASPGTSSTGSPGSSTPSGATGSPGSSTPSGATGSPGTSTEPSEGSA PGSEPATSGSETPGSPAGSPTSTEEGTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGTSSTAESPGPGSTSSTAESPGPGTSPSGES STAPGSEPATSGSETPGSEPATSGSETPGTSTEPSEGSAPGTSSTAESPGPGTSTPESGS ASPGTSSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPTMPLSNLFTNAVLRAQHLHLLAAETYKEFERTYIPEDQRYTNK NSQAAFCYSETIPAPTGKDDAQQKSDMELLRFSLVLIQSWLTPMQYLSKVFTNNLVF GTSDRVFEKLKDLEEGIQALMRELEDRSPRGPQLLRPTYDRFDIHLRSEDALLKNYGL LSCFKKDLHKVETYLKVMKCRRFGESNCNI | 740 |

*Sequence name reflects N- to C-terminus configuration of the growth factor and XTEN components

TABLE 36

Exemplary GHXTEN comprising growth hormones and two XTEN sequences

| GHXTEN Name* | Amino Acid Sequence | SEQ ID NO: |
|---|---|---|
| AE912-bovine GH-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSTEPSEGSAPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTETE YLRVMKCRRFGEASCAFGGSEPATSGSETPGTSESATPESGPGSEPATSGSETPGSPAG SPTSTEEGTSTEPSEGSAPGSEPATSGSETPGSEPATSGSETPGSEPATSGSETPGTSTEP SEGSAPGTSESATPESGPGSEPATSGSETPGTSTEPSEGSAP | 741 |
| AM923-bovine GH-AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGTSSTAESPGPGSTSSTAESPGPGTSPSGES STAPGSEPATSGSETPGSEPATSGSETPGTSTEPSEGSAPGTSSTAESPGPGTSTPESGS ASPGSTSESPSGTAPGTSTEPSEGSAPGTSTEPSEGSAPGTSTEPSEGSAPGSSTPSGATG SPGSSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTNSLVFGTS DRVYEKLKDLEEGILALMRELEDGTPRAGQILKQTYDKFDTNMRSDDALLKNYGLL SCFRKDLHKTETYLRVMKCRRFGEASCAFGGSEPATSGSETPGTSESATPESGPGSEP ATSGSETPGSPAGSPTSTEEGTSTEPSEGSAPGSEPATSGSETPGSEPATSGSETPGSEPA TSGSETPGTSTEPSEGSAPGTSESATPESGPGSEPATSGSETPGTSTEPSEGSAP | 742 |
| AE912-bovine GH-AE288 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVERAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTETE YLRVMKCRRFGEASCAFGGSESATPESGPGSEPATSGSETPGTSESATPESGPGSEPA TSGSETPGTSESATPESGPGTSTEPSEGSAPGSPAGSPTSTEEGTSESATPESGPGSEPAT SGSETPGTSESATPESGPGSPAGSPTSTEEGSPAGSPTSTEEGTSTEPSEGSAPGTSESAT PESGPGTSESATPESGPGTSESATPESGPGSEPATSGSETPGSEPATSGSETPGSPAGSPT STEEGTSTEPSEGSAPGTSTEPSEGSAPGSEPATSGSETPGTSESATPESGPGTSTEPSEG SAP | 743 |
| AM923-bovine GH-AE288 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS | 744 |

TABLE 36-continued

Exemplary GHXTEN comprising growth hormones and two XTEN sequences

| GHXTEN Name* | Amino Acid Sequence | SEQ ID NO: |
|---|---|---|
|  | TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTNSLVFGTS DRVYEKLKDLEEGILALMREEDGTPRAGQILKQTYDKFDTNMRSDDALLKNYGLL SCFRKDLHKTETYLRVMKCRRFGEASCAFGGTSESATPESGPGSEPATSGSETPGTSE SATPESGPGSEPATSGSETPGSTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEP SEGSAPGTSESATPESGPGTSESATPESGPGTSESATPESGPGSEPATSGSETPGSEPATS GSETPGSPAGSPTSTEEGTSTEPSEGSAPGTSTEPSEGSAPGSEPATSGSETPGTSESATP ESGPGTSTEPSEGSAP |  |
| AE912-bovine GH G98-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTQSLVFGTSDRVYEKLKDLE EGILALMREEDGTPRAGQILKQTYDKFDTNMRSDDALLKNYGLLSCFRKDLHKTET YLRVMKCRRFGEASCAFGGSEPATSGSETPGTSESATPESGPGSEPATSGSETPGSPAG SPTSTEEGTSTEPSEGSAPGSEPATSGSETPGSEPATSGSETPGSEPATSGSETPGTSTEP SEGSAPGTSESATPESGPGSEPATSGSETPGTSTEPSEGSAP | 745 |
| AM923-bovine GH G98-AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTQSLVFGTS DRVYEKLKDLEEGILALMREEDGTPRAGQILKQTYDKFDTNMRSDDALLKNYGLL SCFRKDLHKTETYLRVMKCRRFGEASCAFGGSEPATSGSETPGSPAGSPTSTEEGPSEP ATSGSETPGSPAGSPTSTEEGTSTEPSEGSAPGSEPATSGSETPGSEPATSGSETPGSEPA TSGSETPGTSTEPSEGSAPGTSESATPESGPGSEPATSGSETPGTSTEPSEGSAP | 746 |
| AE912-porcine GH-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP | 747 |

TABLE 36-continued

Exemplary GHXTEN comprising growth hormones and two XTEN sequences

| GHXTEN Name* | Amino Acid Sequence | SEQ ID NO: |
|---|---|---|
| | ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPTMPLSSLFANAVLRAQHLHQLAADTYKEFERAYIPEGQRYSIQNAQAAFCFSETIP APTGKDEAQQRSDVELLRFSLLLIQSWLGPVQFLSRVFTNSLVFGTSDRVYEKLKDLE EGIQALMRELEDGSPRAGQILKQTYDKFDTNLRSDDALLKNYGLLSCFKKDLHKAET YLRVMKCRRFVESSCAFGGSEPATSGSETPGTSESATPESGPGSEPATSGSETPGSPAG SPTSTEEGTSTEPSEGSAPGSEPATSGSETPGSEPATSGSETPGTSTEP SEGSAPGTSESATPESGPGSEPATSGSETPGTSTEPSEGSAP | |
| AE912-porcine GH-AE288 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPTMPLSSLFANAVLRAQHLHQLAADTYKEFERAYIPEGQRYSIQNAQAAFCFSETIP APTGKDEAQQRSDVELLRFSLLLIQSWLGPVQFLSRVFTNSLVFGTSDRVYEKLKDLE EGIQALMRELEDGSPRAGQILKQTYDKFDTNLRSDDALLKNYGLLSCFKKDLHKAET YLRVMKCRRFVESSCAFGGTSESATPESGPGSEPATSGSETPGTSESATPESGPGSEPA TSGSETPGTSESATPESGPGTSTEPSEGSAPGSPAGSPTSTEEGTSESATPESGPGSEPAT SGSETPGTSESATPESGPGSPAGSPTSTEEGSPAGSPTSTEEGTSTEPSEGSAPGTSESAT PESGPGTSESATPESGPGTSESATPESGPGSEPATSGSETPGSEPATSGSETPGSPAGSPT STEEGTSTEPSEGSAPGTSTEPSEGSAPGSEPATSGSETPGTSESATPESGPGTSTEPSEG SAP | 748 |
| AE912-horse GH-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMPLSSLFANAVLRAQHLHQLAADTYKEFERAYIPEGQRYSIQNAQAAFCFSETIP APTGKDEAQQRSDMELLRFSLLLIQSWLGPVQLLSRVFTNSLVFGTSDRVYEKLRDL EEGIQALMRELEDGSPRAGQILKQTYDKFDTNLRSDDALLKNYGLLSCFKKDLHKAE TYLRV MKCRRFVESSCAFGGSEPATSGSETPGTSESATPESGPGSEPATSGSETPGSPAGSPTST EEGTSTEPSEGSAPGSEPATSGSETPGSEPATSGSETPGSEPATSGSETPGTSTEPSEGSA PGTSESATPESGPGSEPATSGSETPGTSTEPSEGSAP | 749 |
| AE912-horse GH-AE288 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE | 750 |

TABLE 36-continued

Exemplary GHXTEN comprising growth hormones and two XTEN sequences

| GHXTEN Name* | Amino Acid Sequence | SEQ ID NO: |
|---|---|---|
| | GTSTEPSEGSAPGTSTEPSEGSAPGSEPATSGSETPGTSESATPESGPGTSTEPSEGSAPG<br>FPAMPLSSLFANAVLRAQHLHQLAADTYKEFERAYIPEGQRYSIQNAQAAFCFSETIP<br>APTGKDEAQQRSDMELLRFSLLLIQSWLGPVQLLSRVFTNSLVFGTSDRVYEKLRDL<br>EEGIQALMRELEDGSPRAGQILKQTYDKFDTNLRSDDALLKNYGLLSCFKKDLHKAE<br>TYLRV<br>MKCRRFVESSCAFGGTSESATPESGPGSEPATSGSETPGTSESATPESGPGSEPATSGSE<br>TPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGP<br>GTSESATPESGPGTSESATPESGPGSEPATSGSETPGSEPATSGSETPGSPAGSPTSTEEG<br>TSTEPSEGSAPGTSTEPSEGSAPGSEPATSGSETPGTSESATPESGPGTSTEPSEGSAP | |
| AE912-<br>chicken<br>GH-<br>AE144 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGSTSEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMPLSNLFANAVLRAQHLHLLAAETYKEFERTYIPEDQRYTNKNSQAAFCYSETIP<br>APTGKDDAQQKSDMELLRFSLVLIQSWLTPVQYLSKVFTNNLVFGTSDRVFEKLKDL<br>EEGIQALMRELEDRSPRGPQLLRPTYDKFDIHLRNEDALLKNYGLLSCFKKDLHKVE<br>TYLKVMKCRRFGESNCTIGGSEPATSGSETPGTSESATPESGPGSEPATSGSETPGSPA<br>GSPTSTEEGTSTEPSEGSAPGSEPATSGSETPGSEPATSGSETPGSEPATSGSETPGTSTE<br>PSEGSAPGTSESATPESGPGSEPATSGSETPGTSTEPSEGSAP | 751 |
| AE912-<br>chicken<br>GH-<br>AE288 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMPLSNLFANAVLRAQHLHLLAAETYKEFERTYIPEDQRYTNKNSQAAFCYSETIP<br>APTGKDDAQQKSDMELLRFSLVLIQSWLTPVQYLSKVFTNNLVFGTSDRVFEKLKDL<br>EEGIQALMRELEDRSPRGPQLLRPTYDKFDIHLRNEDALLKNYGLLSCFKKDLHKVE<br>TYLKVMKCRRFGESNCTIGGTSESATPESGPGSEPATSGSETPGSPGSEPATSGSEP<br>ATSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSESA<br>TPESGPGTSESATPESGPGTSESATPESGPGSEPATSGSETPGSEPATSGSETPGSPAGSP<br>TSTEEGTSTEPSEGSAPGTSTEPSEGSAPGSEPATSGSETPGTSESATPESGPGTSTEPSE<br>GSAP | 752 |
| AE912-<br>bovine<br>GH-<br>AE144 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGSTSEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP | 753 |

TABLE 36-continued

Exemplary GHXTEN comprising growth hormones and two XTEN sequences

| GHXTEN Name* | Amino Acid Sequence | SEQ ID NO: |
|---|---|---|
| | APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGGSEPATSGSETPGTSESATPESGPGSEPATSGSETPGSPAG<br>SPTSTEEGTSTEPSEGSAPGSEPATSGSETPGSEPATSGSETPGSEPATSGSETPGTSTEP<br>SEGSAPGTSESATPESGPGSEPATSGSETPGTSTEPSEGSAP | |
| AE912-<br>bovine<br>GH-<br>AE288 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP<br>APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGGTSESATPESGPGSEPATSGSETPGTSESATPESGPGSEPA<br>TSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESAT<br>PESGPGTSESATPESGPGTSESATPESGPGSEPATSGSETPGSEPATSGSETPGSPAGSPT<br>STEEGTSTEPSEGSAPGTSTEPSEGSAPGSEPATSGSETPGTSESATPESGPGTSTEPSEG<br>SAP | 754 |
| AE912-<br>turkey<br>GH-<br>AE144 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPTMPLSNLFTNAVLRAQHLHLLAAETYKEFERTYIPEDQRYTNKNSQAAFCYSETIP<br>APTGKDDAQQKSDMELLRFSLVLIQSWLTPMQYLSKVFTNNLVFGTSDRVFEKLKDL<br>EEGIQALMRELEDRSPRGPQLLRPTYDRFDIHLRSEDALLKNYGLLSCFKKDLHKVET<br>YLKVMKCRRFGESNCNIGGSEPATSGSETPGTSESATPESGPGSEPATSGSETPGSPAG<br>SPTSTEEGTSTEPSEGSAPGSEPATSGSETPGSEPATSGSETPGSEPATSGSETPGTSTEP<br>SEGSAPGTSESATPESGPGSEPATSGSETPGTSTEPSEGSAP | 755 |
| AE912-<br>turkey<br>GH-<br>AE288 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPTMPLSNLFTNAVLRAQHLHLLAAETYKEFERTYIPEDQRYTNKNSQAAFCYSETIP<br>APTGKDDAQQKSDMELLRFSLVLIQSWLTPMQYLSKVFTNNLVFGTSDRVFEKLKDL<br>EEGIQALMRELEDRSPRGPQLLRPTYDRFDIHLRSEDALLKNYGLLSCFKKDLHKVET<br>YLKVMKCRRFGESNCNIGGTSESATPESGPGSEPATSGSETPGTSESATPESGPGSEPA<br>TSGSETPGTSESATPESGPGTSTEPSEGSAPGSPAGSPTSTEEGTSESATPESGPGSEPAT<br>SGSETPGTSESATPESGPGSPAGSPTSTEEGSPAGSPTSTEEGTSTEPSEGSAPGTSESAT | 756 |

TABLE 36-continued

Exemplary GHXTEN comprising growth hormones and two XTEN sequences

| GHXTEN Name* | Amino Acid Sequence | SEQ ID NO: |
|---|---|---|
| | PESGPGTSESATPESGPGTSESATPESGPGSEPATSGSETPGSEPATSGSETPGSPAGSPT STEEGTSTEPSEGSAPGTSTEPSEGSAPGSEPATSGSETPGTSESATPESGPGTSTEPSEG SAP | |

*Sequence name reflects N- to C-terminus configuration of the growth factor and XTEN components

TABLE 37

Exemplary GHXTEN comprising growth hormones, XTEN and cleavage sequences

| GHXTEN Name* | Amino Acid Sequence | SEQ ID NO: |
|---|---|---|
| AE912-bovine GH-Thrombin-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTET YLRVMKCRRFGEASCAFGLTPRSLLVGGGGSEPATSGSETPGTSESATPESGPGSEPA TSGSETPGSPAGSPTSTEEGTSTEPSEGSAPGSEPATSGSETPGSEPATSGSETPGSEPAT SGSETPGTSTEPSEGSAPGTSESATPESGPGSEPATSGSETPGTSTEPSEGSAP | 757 |
| AE912-bovine GH-FXIa-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTET YLRVMKCRRFGEASCAFGGGKLTRVVGGGGSEPATSGSETPGTSESATPESGPGSEP ATSGSETPGSPAGSPTSTEEGTSTEPSEGSAPGSEPATSGSETPGSEPATSGSETPGSEPA TSGSETPGTSTEPSEGSAPGTSESATPESGPGSEPATSGSETPGTSTEPSEGSAP | 758 |
| AE912-bovine GH-Elastase-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE | 759 |

TABLE 37-continued

Exemplary GHXTEN comprising growth hormones, XTEN and cleavage sequences

| GHXTEN Name* | Amino Acid Sequence | SEQ ID NO: |
|---|---|---|
| | GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP<br>APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGGGLGPVSGVPGGSEPATSGSETPGTSESATPESGPGSEPA<br>TSGSETPGSPAGSPTSEEGTSTEPSEGSAPGSEPATSGSETPGSEPATSGSETPGSEPAT<br>SGSETPGTSTEPSEGSAPGTSESATPESGPGSEPATSGSETPGTSTEPSEGSAP | |
| AE912-<br>bovine<br>GH-<br>MMP-17-<br>AE144 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP<br>APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGAPLGLRLRGGGGSEPATSGSETPGTSESATPESGPGSEPA<br>TSGSETPGSPAGSPTSTEEGTSTEPSEGSAPGSEPATSGSETPGSEPATSGSETPGSEPAT<br>SGSETPGTSTEPSEGSAPGTSESATPESGPGSEPATSGSETPGTSTEPSEGSAP | 760 |
| AE912-<br>bovine<br>GH-<br>Thrombin-<br>AE288 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGSPAGSPTSTEEGSP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP<br>APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGLTPRSLLVGGGGTSESATPESGPGSEPATSGSETPGTSES<br>ATPESGPGSEPATSGSETPGTSESATPESGPGTSTEPSEGSAPGSPAGSPTSTEEGTSESA<br>TPESGPGSEPATSGSETPGTSESATPESGPGSPAGSPTSTEEGSPAGSPTSTEEGTSTEPS<br>EGSAPGTSESATPESGPGTSESATPESGPGTSESATPESGPGSEPATSGSETPGSEPATS<br>GSETPGSPAGSPTSTEEGTSTEPSEGSAPGTSTEPSEGSAPGSEPATSGSETPGTSESATP<br>ESGPGTSTEPSEGSAP | 761 |
| AE912-<br>bovine<br>GH-FXIa-<br>AE288 | MAEPAGSPTSTEEGTPGSGTASSSPGSSTPSGATGSPGASPGTSSTGSPGSPAGSPTSTE<br>EGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGT<br>SESATPESGPGTSTEPSEGSAPGTSESATPESGPGSEPATSGSETPGTSTEPSEGSAPGTS<br>TEPSEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTSTEPS<br>EGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGTSESATPESGPGSEPATSGS<br>ETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESG<br>PGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPG<br>FPAMSLSGLFANAVLRAQHLHQLAADTFKEFERTYIPEGQRYSIQNTQVAFCFSETIP<br>APTGKNEAQQKSDLELLRISLLLIQSWLGPLQFLSRVFTNSLVFGTSDRVYEKLKDLE<br>EGILALMRELEDGTPRAGQILKQTYDKFDTNMRSDDALLKNYGLLSCFRKDLHKTET<br>YLRVMKCRRFGEASCAFGGGKLTRVVGGGGTSESATPESGPGSEPATSGSETPGTSES | 762 |

TABLE 37-continued

Exemplary GHXTEN comprising growth hormones, XTEN and cleavage sequences

| GHXTEN Name* | Amino Acid Sequence | SEQ ID NO: |
|---|---|---|
| | ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPS EGSAPGTSESATPESGPGTSESATPESGPGTSESGPGSEPATSGSETPGSEPATS GSETPGSPAGSPTSTEEGTSTEPSEGSAPGTSTEPSEGSAPGSEPATSGSETPGTSESATP ESGPGTSTEPSEGSAP | |
| AE912- bovine GH- Elastase- AE288 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGSAPG FPAMSLSGLFANAVLRAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTET YLRVMKCRRFGEASCAFGGGLGPVSGVPGGTSESATPESGPGSEPATSGSETPGTSES ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPS EGSAPGTSESATPESGPGTSESATPESGPGTSESATPESGPGSEPATSGSETPGSEPATS GSETPGSPAGSPTSTEEGTSTEPSEGSAPGTSEGSAPGSEPATSGSETPGTSESATP ESGPGTSTEPSEGSAP | 763 |
| AE912- bovine GH- MMP-17- AE288 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESG PGTSESATPESGPGSEPATSGSETPGSEPATSGSETPGSPAGSPTSTEEGTSTEPSEGSAPG FPAMSLSGLFANAVERAQHLHQLAADTFKEFERTYIPEGQRYSIQNTQVAFCFSETIP APTGKNEAQQKSDLELLRISLLLIQSWLGPLQFLSRVFTNSLVFGTSDRVYEKLKDLE EGILALMRELEDGTPRAGQILKQTYDKFDTNMRSDDALLKNYGLLSCFRKDLHKTET YLRVMKCRRFGEASCAFGAPLGLRLRGGGGTSESATPESGPGSEPATSGSETPGTSES ATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGSPAGSPTSTEEGTSTEPS EGSAPGTSESATPESGPGTSESATPESGPGTSESATPESGPGSEPATSGSETPGSEPATS GSETPGSPAGSPTSTEEGTSTEPSEGSAPGTSEGSAPGSEPATSGSETPGTSESATP ESGPGTSTEPSEGSAP | 764 |
| AM923- bovine GH G98- Thrombin- AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSTEPSEGSAPGTS TEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGTSSTAESPGPGSTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTPSEGSASPGTSESGSAPGSTPSGATGS SPGSSPSASTGTGPGASPGTSSTGSPGTSESATPESGPGTSTEPSEGSAP GTSTEPSEGSAPGFPAMSLSGLFANAVERAQHLHQLAADTFKEFERTYIPEGQRYSIQ NTQVAFCFSETIPAPTGKNEAQQKSDLELLRISLLLIQSWLGPLQFLSRVFTQSLVFGTS DRVYEKLKDLEEGILALMRELEDGTPRAGQILKQTYDKFDTNMRSDDALLKNYGLL | 765 |

TABLE 37-continued

Exemplary GHXTEN comprising growth hormones, XTEN and cleavage sequences

| GHXTEN Name* | Amino Acid Sequence | SEQ ID NO: |
|---|---|---|
| | SCFRKDLHKTETYLRVMKCRRFGEASCAFGLTPRSLLVGGGGSEPATSGSETPGTSES ATPESGPGSEPATSGSETPGSPAGSPTSTEEGTSTEPSEGSAPGSEPATSGSETPGSEPAT SGSETPGSEPATSGSETPGTSTEPSEGSAPGTSESATPESGPGSEPATSGSETPGTSTEPS EGSAP | |
| AM923-bovine GH G98-FXIa-AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMSLSGLFANAVLRAQHLHQLAADTFKEFERTYIPEGQRYSIQ NTQVAFCFSETIPAPTGKNEAQQKSDLELLRISLLLIQSWLGPLQFLSRVFTQSLVFGTS DRVYEKLKDLEEGILALMRELEDGTPRAGQILKQTYDKFDTNMRSDDALLKNYGLL SCFRKDLHKTETYLRVMKCRRFGEASCAFGGGKLTRVVGGGGSEPATSGSETPGTSE SATPESGPGSEPATSGSETPGSPAGSPTSTEEGTSTEPSEGSAPGSEPATSGSETPGSEPA TSGSETPGSEPATSGSETPGTSTEPSEGSAPGTSESATPESGPGSEPATSGSETPGTSTEP SEGSAP | 766 |
| AM923-porcine GH-Elastase-AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPTMPLSSLFANAVLRAQHLHQLAADTYKEFERAYIPEGQRYSIQ NAQAAFCFSETIPAPTGKDEAQQRSDVELLRFSLLLIQSWLGPVQFLSRVFTNSLVFGT SDRVYEKLKDLEEGIQALMRELEDGSPRAGQILKQTYDKFDTNLRSDDALLKNYGLL SCFKKDLHKAETYLRVMKCRRFVESSCAFGGGLGPVSGVPGGSEPATSGSETPGTSES ATPESGPGSEPATSGSETPGSPAGSPTSTEEGTSTEPSEGSAPGSEPATSGSETPGSEPAT SGSETPGSEPATSGSETPGTSTEPSEGSAPGTSESATPESGPGSEPATSGSETPGTSTEPS EGSAP | 767 |
| AM923-porcine GH-MMP-17-AE144 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPTMPLSSLFANAVLRAQHLHQLAADTYKEFERAYIPEGQRYSIQ NAQAAFCFSETIPAPTGKDEAQQRSDVELLRFSLLLIQSWLGPVQFLSRVFTNSLVFGT SDRVYEKLKDLEEGIQALMRELEDGSPRAGQILKQTYDKFDTNLRSDDALLKNYGLL SCFKKDLHKAETYLRVMKCRRFVESSCAFGAPLGLRLRGGGGSEPATSGSETPGTSES ATPESGPGSEPATSGSETPGSPAGSPTSTEEGTSTEPSEGSAPGSEPATSGSETPGSEPAT SGSETPGSEPATSGSETPGTSTEPSEGSAPGTSESATPESGPGSEPATSGSETPGTSTEPS EGSAP | 768 |

TABLE 37-continued

Exemplary GHXTEN comprising growth hormones, XTEN and cleavage sequences

| GHXTEN Name* | Amino Acid Sequence | SEQ ID NO: |
|---|---|---|
| AM923-horse GH-Thrombin-AE288 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMPLSSLFANAVLRAQHLHQLAADTYKEFERAYIPEGQRYSIQ NAQAAFCFSETIPAPTGKDEAQQRSDMELLRFSLLLIQSWLGPVQLLSRVFTNSLVFG TSDRVYEKLRDLEEGIQALMRELEDGSPRAGQILKQTYDKFDTNLRSDDALLKNYGL LSCFKKDLHKAETYLRV MKCRRFVESSCAFGLTPRSLLVGGGGTSESATPESGPGSEPATSGSETPGTSESATPES GPGSEPATSGSETPGTSESATPESGPGTSTEPSEGSAPGSPAGSPTSTEEGSTSESATPESG PGSEPATSGSETPGTSESATPESGPGSPAGSPTSTEEGSPAGSPTSTEEGTSTEPSEGSAP GTSESATPESGPGTSESATPESGPGSEPATSGSETPGSEPATSGSETPG SPAGSPTSTEEGSTSTEPSEGSAPGTSTEPSEGSAPGSEPATSGSETPGTSESATPESGPGT STEPSEGSAP | 769 |
| AM923-horse GH-FXIa-AE288 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMPLSSLFANAVLRAQHLHQLAADTYKEFERAYIPEGQRYSIQ NAQAAFCFSETIPAPTGKDEAQQRSDMELLRFSLLLIQSWLGPVQLLSRVFTNSLVFG TSDRVYEKLRDLEEGIQALMRELEDGSPRAGQILKQTYDKFDTNLRSDDALLKNYGL LSCFKKDLHKAETYLRV MKCRRFVESSCAFGGGKLTRVVGGGGTSESATPESGPGSEPATSGSETPGTSESATPE SGPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPATSGSETP GSPAGSPTSTEEGSTSTEPSEGSAPGTSTEPSEGSAPGSEPATSGSETPGTSESATPESGPG TSTEPSEGSAP | 770 |
| AM923-chicken GH-Elastase-AE288 | MAEPAGSPTSTEEGASPGTSSTGSPGSSTPSGATGSPGSSTPSGATGSPGTSTEPSEGSA PGSEPATSGSETPGSPAGSPTSTEEGSTSSTAESPGPGTSTPESGSASPGSTSESPSGTAP GSTSESPSGTAPGTSTPESGSASPGTSTPESGSASPGSEPATSGSETPGTSESATPESGPG SPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGSTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGSTSSTAESPGPGTSSTAESPGPGTSPSGES STAPGSEPATSGSETPGSEPATSGSETPGTSTEPSEGSAPGSTSSTAESPGPGTSTPESGS ASPGSTSESPSGTAPGTSTEPSEGSAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMPLSNLFANAVLRAQHLHLLAAETYKEFERTYIPEDQRYTNK NSQAAFCYSETIPAPTGKDDAQQKSDMELLRFSLVLIQSWLTPVQYLSKVFTNNLVF GTSDRVFEKLKDLEEGIQALMRELEDRSPRGPQLLRPTYDKFDIHLRNEDALLKNYG LLSCFKKDLHKVETYLKVMKCRRFGESNCTIGGGLGPVSGVPGGTSESATPESGPGSE PATSGSETPGTSESATPESGPGSEPATSGSETPGTSESATPESGPGTSTEPSEGSAPGSPA GSPTSTEEGTSESATPESGPGSEPATSGSETPGTSESATPESGPGSPAGSPTSTEEGSPAG SPTSTEEGTSTEPSEGSAPGTSESATPESGPGTSESATPESGPGTSESATPESGPGSEPAT | 771 |

TABLE 37-continued

Exemplary GHXTEN comprising growth hormones, XTEN and cleavage sequences

| GHXTEN Name* | Amino Acid Sequence | SEQ ID NO: |
|---|---|---|
| | SGSETPGSEPATSGSETPGSPAGSPTSTEEGTSTEPSEGSAPGTSTEPSEGSAPGSEPATS GSETPGTSESATPESGPGTSTEPSEGSAP | |
| AM923-chicken GH-MMP-17-AE288 | MAEPAGSPTSTEEGASPGTSSTGSPGSSTPSGATGSPGSSTPSGATGSPGTSTEPSEGSA PGSEPATSGSETPGSPAGSPTSTEEGTSSTAESPGPGTSTPESGSASPGSTSESPSGTAP GSTSESPSGTAPGTSTPESGSASPGSTSTPESGSASPGSEPATSGSETPGTSESATPESG PGSPAGSPTSTEEGTSTEPSEGSAPGTSESATPESGPGTSTEPSEGSAPGTSTEPSEGSAPGS PAGSPTSTEEGTSTEPSEGSAPGTSTEPSEGSAPGTSESATPESGPGTSESATPESGPGTS TEPSEGSAPGTSTEPSEGSAPGTSESATPESGPGTSTEPSEGSAPGSEPATSGSETPGSPA GSPTSTEEGSSTPSGATGSPGTPGSGTASSSPGSSTPSGATGSPGTSTEPSEGSAPGTSTE PSEGSAPGSEPATSGSETPGSPAGSPTSTEEGSPAGSPTSTEEGTSTEPSEGSAPGASAS GAPSTGGTSESATPESGPGSPAGSPTSTEEGSPAGSPTSTEEGTSSTAESPGPGSTSESP SGTAPGTSPSGESSTAPGTPGSGTASSSPGSSTPSGATGSPGSSPSASTGTGPGSEPATS GSETPGTSESATPESGPGSEPATSGSETPGTSSTAESPGPGSTSSTAESPGPGTSPSGES STAPGSEPATSGSETPGSEPATSGSETPGTSTEPSEGSAPGTSSTAESPGPGTSTPESGS ASPGSTSESPSGTAPGTSTEPSEGSAPGTSTEPSEGSAPGSSTPSGATG SPGSSPSASTGTGPGASPGTSSTGSPGSEPATSGSETPGTSESATPESGPGSPAGSPTSTE EGSSTPSGATGSPGSSPSASTGTGPGASPGTSSTGSPGTSESATPESGPGTSTEPSEGSAP GTSTEPSEGSAPGFPAMPLSNLFANAVLRAQHLHLLAAETYKEFERTYIPEDQRYTNK NSQAAFCYSETIPAPTGKDDAQQKSDMELLRFSLVLIQSWLTPVQYLSKVFTNNLVF GTSDRVFEKLKDLEEGIQALMRELEDRSPRGPQLLRPTYDKFDIHLRNEDALLKNYG LLSCFKKDLHKVETYLKVMKCRRFGESNCTIGAPLGLRLRGGGGTSESATPESGPGSE PATSGSETPGTSESATPESGPGSEPATSGSETPGTSESATPESGPGTSTEPSEGSAPGSPA GSPTSTEEGTSESATPESGPGSEPATSGSETPGTSESATPESGPGSPAGSPTSTEEGSPAG SPTSTEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGSEPATS GSETPGTSESATPESGPGTSTEPSEGSAP | 772 |
| AE624-bovine GH-Thrombin-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSESA SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPAMSLSGLFANAVLRAQHLHQLAADTFKEFERTYIPEGQR YSIQNTQVAFCFSETIPAPTGKNEAQQKSDLELLRISLLLIQSWLGPLQFLSRVFTNSLV FGTSDRVYEKLKDLEEGILALMRELEDGTPRAGQILKQTYDKFDTNMRSDDALLKN YGLLSCFRKDLHKTETYLRVMKCRRFGEASCAFGLTPRSLLVGGGGSEPATSGSETP GTSESATPESGPGSEPATSGSETPGSPAGSPTSTEEGTSTEPSEGSAPGSEPATSGSETPG SEPATSGSETPGSEPATSGSETPGTSTEPSEGSAPGTSESATPESGPGSEPATSGSETPGT STEPSEGSAP | 773 |
| AE624-bovine GH-FXIa-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPAMSLSGLFANAVLRAQHLHQLAADTFKEFERTYIPEGQR YSIQNTQVAFCFSETIPAPTGKNEAQQKSDLELLRISLLLIQSWLGPLQFLSRVFTNSLV FGTSDRVYEKLKDLEEGILALMRELEDGTPRAGQILKQTYDKFDTNMRSDDALLKN YGLLSCFRKDLHKTETYLRVMKCRRFGEASCAFGGGKLTRVVGGGGSEPATSGSETP GTSESATPESGPGSEPATSGSETPGSPAGSPTSTEEGTSTEPSEGSAPGSEPATSGSETPG SEPATSGSETPGSEPATSGSETPGTSTEPSEGSAPGTSESATPESGPGSEPATSGSETPGT STEPSEGSAP | 774 |
| AE624-turkey GH-Elastase-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP | 775 |

TABLE 37-continued

Exemplary GHXTEN comprising growth hormones, XTEN and cleavage sequences

| GHXTEN Name* | Amino Acid Sequence | SEQ ID NO: |
|---|---|---|
| | ESGPGTSTEPSEGSAPGFPTMPLSNLFTNAVLRAQHLHLLAAETYKEFERTYIPEDQR YTNKNSQAAFCYSETIPAPTGKDDAQQKSDMELLRFSLVLIQSWLTPMQYLSKVFTN NLVFGTSDRVFEKLKDLEEGIQALMRELEDRSPRGPQLLRPTYDRFDIHLRSEDALLK NYGLLSCFKKDLHKVETYLKVMKCRRFGESNCNIGGGLGPVSGVPGGSEPATSGSET PGTSESATPESGPGSEPATSGSETPGSPAGSPTSTEEGTSTEPSEGSAPGSEPATSGSETP GSEPATSGSETPGSEPATSGSETPGTSTEPSEGSAPGTSESATPESGPGSEPATSGSETPG TSTEPSEGSAP | |
| AE624-turkey GH-MMP-17-AE144 | MAEPAGSPTSTEEGTPGSGTASSSPGSSTPSGATGSPGASPGTSSTGSPGSPAGSPTSTE EGTSESATPESGPGTSTEPSEGSAPGSPAGSPTSTEEGTSTEPSEGSAPGTSTEPSEGSAP GTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGT SESATPESGPGTSTEPSEGSAPGTSESATPESGPGSEPATSGSETPGTSTEPSEGSAPGTS TEPSEGSAPGTSESATPESGPGTSESATPESGPGSPAGSPTSTEEGTSESATPESGPGSEP ATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTSTEPS EGSAPGTSESATPESGPGSPAGSPTSTEEGSPAGSPTSTEEGSPAGSPTSTEEGTSESATP ESGPGTSTEPSEGSAPGFPTMPLSNLFTNAVLRAQHLHLLAAETYKEFERTYIPEDQR YTNKNSQAAFCYSETIPAPTGKDDAQQKSDMELLRFSLVLIQSWLTPMQYLSKVFTN NLVFGTSDRVFEKLKDLEEGIQALMRELEDRSPRGPQLLRPTYDRFDIHLRSEDALLK NYGLLSCFKKDLHKVETYLKVMKCRRFGESNCNIGAPLGLRLRGGGGSEPATSGSET PGTSESATPESGPGSEPATSGSETPGSPAGSPTSTEEGTSTEPSEGSAPGSEPATSGSETP GSEPATSGSETPGSEPATSGSETPGTSTEPSEGSAPGTSESATPESGPGSEPATSGSETPG TSTEPSEGSAP | 776 |

*Sequence name reflects N- to C-terminus configuration of the growth factor, cleavage sequence and XTEN components

SEQUENCE LISTING (782 sequences)

SEQ ID NO: 1 - protein, 191 aa, Homo sapiens [sequence omitted]

SEQ ID NO: 2 - protein, 190 aa, Sus sp.
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 3 - protein, 190 aa, Vicugna pacos
FPAMPLSSLFANAVLRAQHLHQLAADTYKEFERTYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILRQTYDKFDTNLRSDDALLKNYGLLSCFKKDLHKAETYLRVMKCRRFVESSCAF

SEQ ID NO: 4 - protein, 190 aa, Camelus sp.; identical to SEQ ID NO: 3

SEQ ID NO: 5 - protein, 190 aa, Equus ferus
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 6 - protein, 190 aa, Unknown
  Description of Unknown: Elephant growth hormone protein
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRPGQVLKQTYDKFDTNMRSDDALLKNYGLLSCFKKDLHKAETYLRVMKCRRFVESSCAF

SEQ ID NO: 7 - protein, 190 aa, Vulpes vulpes
FPAMPLSSLFANAVLRAQHLHQLAADTYKEFERAYIPEGQRYSIQNAQAAFCFSETIPAPTGKDEAQQRSDVELLRFSLVLIQSWLGPLQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 8 - protein, 190 aa, Canis familiaris; identical to SEQ ID NO: 2

SEQ ID NO: 9 - protein, 190 aa, Felis catus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRGGQILKQTYDKFDTNLRSDDALLKNYGLLSCFKKDLHKAETYLRVMKCRRFVESSCAF

SEQ ID NO: 10 - protein, 190 aa, Neovison vison
FPAMPLSSLFANAVLRAQHLHQLAADTYKDFERAYIPEGQRYSIQNAQAAFCFSETIPAPTGKDEAQQRSDMELLRFSLLLIQSWLGPVQFLSRVFTNSLVFGTSDRVYEKLKDLEEGIQALMRELEDGSPRAGPILKQTYDKFDTNLRSDDALLKNYGLLSCFKKDLHKAETYLRVMKCRRFVESSCAF

SEQ ID NO: 11 - protein, 190 aa, Balaenoptera physalus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 12 - protein, 190 aa, Unknown
  Description of Unknown: Dolphin growth hormone protein
FPAMPLSSLFANAVLRAQHLHQLAADTYKEFERAYIPEGQRYSIQNTQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 13 - protein, 190 aa, Hippopotamus amphibius; identical to SEQ ID NO: 12

SEQ ID NO: 14 - protein, 190 aa, Unknown
  Description of Unknown: Rabbit growth hormone protein
FPAMPLSSLFANAVLRAQHLHQLAADTYKEFERAYIPEGQRYSIQNAQAAFCFSETIPAPTGKDEAQQRSDMELLRFSLLLIQSWLGPVQFLSRAFTNTLVFGTSDRVYEKLKDLEEGIQALMRELEDGSPRVGQLLKQTYDKFDTNLRGDDALLKNYGLLSCFKKDLHKAETYLRVMKCRRFVESSCVF

SEQ ID NO: 15 - protein, 190 aa, Rattus sp.
FPAMPLSSLFANAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRIGQILKQTYDKFDANMRSDDALLKNYGLLSCFKKDLHKAETYLRVMKCRRFAESSCAF

SEQ ID NO: 16 - protein, 190 aa, Mus sp.
FPAMPLSSLFSNAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRVGQILKQTYDKFDANMRSDDALLKNYGLLSCFKKDLHKAETYLRVMKCRRFVESSCAF

SEQ ID NO: 17 - protein, 190 aa, Unknown
  Description of Unknown: Hamster growth hormone protein
FPAMPLSSLFANAVLRAQHLHQLAADTYKEFERAYIPEGQRYSIQNAQTAFCFSETIPAPTGKEEAQQRSDMELLRFSLLLIQSWLGPVQFLSRIFTNSLMFGTSDRVYEKLKDLEEGIQALMQELEDGSPRVGQILKQTYDKFDTNMRSDDALLKNYGLLSCFKKDLHKAETYLRVMKCRRFVESSCAF

SEQ ID NO: 18 - protein, 190 aa, Unknown
  Description of Unknown: Mole rat growth hormone protein
FPAMPLSNLFANAVLRAQHLHQLAADTYKEFERAYIPEGQRYSIQNAQAAFCFSETIPAPTGKEEAQQRSDMELLRFSLLLIQSWLGPVQFLSRVFTNSLVFGTSDRVFEKLKDLEEGIQALMRELEDGSLRAGQLLKQTYDKFDTNMRSDDALLKNYGLLSCFKKDLHKAETYLRVMKCRRFVESSCAF

SEQ ID NO: 19 - protein, 190 aa, Cavia porcellus
FPAMPLSSLFGNAVLRAQHLHQLAADTYKEFERTYIPEGQRYSIHNTQTAFCFSETIPAPTDKEEAQQRSDVELLHFSLLLIQSWLGPVQFLSRVFTNSLVFGTSDRVYEKLKDLEEGIQALMRELEDGTPRAGQILKQTYDKFDTNLRSNDALLKNYGLLSCFRKDLHRTETYLRVMKCRRFVESSCAF

SEQ ID NO: 20 - protein, 191 aa, Unknown
  Description of Unknown: Ox growth hormone protein
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 21 - protein, 191 aa, Unknown
  Description of Unknown: Sheep or Goat growth hormone protein
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDVTPRAGQILKQTYDKFDTNMRSDDALLKNYGLLSCFRKDLHKTETYLRVMKCRRFGEASCAF

SEQ ID NO: 22 - protein, 190 aa, Cervus elaphus
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 23 - protein, 191 aa, Giraffa camelopardalis
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFSNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 24 - protein, 190 aa, Unknown
  Description of Unknown: Chevrotain-1 growth hormone protein
FPAMSLSGLFANAVLRVQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGPPRAGQILKQTYDKFDTNMRSDDALLKNYGLLSCFRKDLHKTETYLRVMKCRRFGEASCAF

SEQ ID NO: 25 - protein, 190 aa, Unknown
  Description of Unknown: Slow loris growth hormone protein
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVLGTSDRVYEKLKDLEEGIQALMRELEDGSPRVGQILKQTYDKFDTNLRSDDALLKNYGLLSCFKKDLHKAETYLRVMKCRRFVESSCAF

SEQ ID NO: 26 - protein, 191 aa, Unknown
  Description of Unknown: Marmoset growth hormone protein
FPTIPLSRLLDNAMLRAHRLHQLAFDTYQEFEEAYIPKEQKYSFLQNPQTSLCFSESIPTPASKKETQQKSNLELLRMSLLLIQSWFEPVQFLRSVFANSLLYGVSDSDVYEYLKDLEEGIQTLMGRLEDGSPRTGEIFMQTYRKFDVNSQNNDALLKNYGLLYCFRKDMDKVETFLRIVQCRSVEGSCGF

SEQ ID NO: 27 - protein, 190 aa, Unknown
  Description of Unknown: BrTailed Possum growth hormone protein
FPAMPLSSLFANAVLRAQHLHQLVADTYKEFERTYIPEAQRHSIQSTQTAFCFSETIPAPTGKDEAQQRSDVELLRFSLLLIQSWLSPVQFLSRVFTNSLVFGTSDRVYEKLRDLEEGIQALMQELEDGSSRGGLVLKTTYDKFDTNLRSDEALLKNYGLLSCFKKDLHKAETYLRVMKCRRFVESSCAF

SEQ ID NO: 28 - protein, 191 aa, Macaca mulatta
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGTSYSDVYDLLKDLEEGIQTLMGRLEDGSSRTGQIFKQTYSKFDTNSHNNDALLKNYGLLYCFRKDMDKIETFLRIVQCRSVEGSCGF

SEQ ID NO: 29 - protein, 12 aa, Artificial Sequence
  Description of Artificial Sequence: Synthetic peptide
GESPGGSSGSES

SEQ ID NO: 30 - protein, 12 aa, Artificial Sequence
  Description of Artificial Sequence: Synthetic peptide
GSEGSSGPGESS

SEQ ID NO: 31 - protein, 12 aa, Artificial Sequence
  Description of Artificial Sequence: Synthetic peptide
GSSESGSSEGGP

SEQ ID NO: 32 - protein, 12 aa, Artificial Sequence
  Description of Artificial Sequence: Synthetic peptide
GSGGEPSESGSS

SEQ ID NO: 33 - protein, 12 aa, Artificial Sequence
  Description of Artificial Sequence: Synthetic peptide
GSPAGSPTSTEE

SEQ ID NO: 34 - protein, 12 aa, Artificial Sequence
  Description of Artificial Sequence: Synthetic peptide
GSEPATSGSETP

SEQ ID NO: 35 - protein, 12 aa, Artificial Sequence
  Description of Artificial Sequence: Synthetic peptide
GTSESATPESGP

SEQ ID NO: 36 - protein, 12 aa, Artificial Sequence
  Description of Artificial Sequence: Synthetic peptide
GTSTEPSEGSAP

SEQ ID NO: 37 - protein, 12 aa, Artificial Sequence
  Description of Artificial Sequence: Synthetic peptide
GSTSESPSGTAP

SEQ ID NO: 38 - protein, 12 aa, Artificial Sequence
  Description of Artificial Sequence: Synthetic peptide
GTSTPESGSASP

SEQ ID NO: 39 - protein, 12 aa, Artificial Sequence
  Description of Artificial Sequence: Synthetic peptide
GTSPSGESSTAP

SEQ ID NO: 40 - protein, 12 aa, Artificial Sequence
  Description of Artificial Sequence: Synthetic peptide
GSTSSTAESPGP

SEQ ID NO: 41 - protein, 12 aa, Artificial Sequence
  Description of Artificial Sequence: Synthetic peptide
GTPGSGTASSSP

SEQ ID NO: 42 - protein, 12 aa, Artificial Sequence
  Description of Artificial Sequence: Synthetic peptide
GSSTPSGATGSP

SEQ ID NO: 43 - protein, 12 aa, Artificial Sequence
  Description of Artificial Sequence: Synthetic peptide
GSSPSASTGTGP

SEQ ID NO: 44 - protein, 12 aa, Artificial Sequence
  Description of Artificial Sequence: Synthetic peptide
GASPGTSSTGSP

SEQ ID NO: 45 - protein, 12 aa, Artificial Sequence
  Description of Artificial Sequence: Synthetic peptide
GEPAGSPTSTSE

SEQ ID NO: 46 - protein, 12 aa, Artificial Sequence
  Description of Artificial Sequence: Synthetic peptide
GTGEPSSTPASE

SEQ ID NO: 47 - protein, 12 aa, Artificial Sequence
  Description of Artificial Sequence: Synthetic peptide
GSGPSTESAPTE

SEQ ID NO: 48 - protein, 12 aa, Artificial Sequence
  Description of Artificial Sequence: Synthetic peptide
GSETPSGPSETA

SEQ ID NO: 49 - protein, 12 aa, Artificial Sequence
  Description of Artificial Sequence: Synthetic peptide
GPSETSTSEPGA

SEQ ID NO: 50 - protein, 12 aa, Artificial Sequence
  Description of Artificial Sequence: Synthetic peptide
GSPSEPTEGTSA

SEQ ID NO: 51 - protein, 12 aa, Artificial Sequence
  Description of Artificial Sequence: Synthetic peptide
GSGASEPTSTEP

SEQ ID NO: 52 - protein, 12 aa, Artificial Sequence
  Description of Artificial Sequence: Synthetic peptide
GSEPATSGTEPS

SEQ ID NO: 53 - protein, 12 aa, Artificial Sequence
  Description of Artificial Sequence: Synthetic peptide
GTSEPSTSEPGA

SEQ ID NO: 54 - protein, 12 aa, Artificial Sequence
  Description of Artificial Sequence: Synthetic peptide
GTSTEPSEPGSA

SEQ ID NO: 55 - protein, 12 aa, Artificial Sequence
  Description of Artificial Sequence: Synthetic peptide
GSTAGSETSTEA

SEQ ID NO: 56 - protein, 12 aa, Artificial Sequence
  Description of Artificial Sequence: Synthetic peptide
GSETATSGSETA

SEQ ID NO: 57 - protein, 12 aa, Artificial Sequence
  Description of Artificial Sequence: Synthetic peptide
GTSESATSESGA

SEQ ID NO: 58 - protein, 12 aa, Artificial Sequence
  Description of Artificial Sequence: Synthetic peptide
GTSTEASEGSAS

SEQ ID NO: 59 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 60 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 61 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 62 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 63 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 64 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 65 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 66 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 67 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 68 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 69 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 70 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 71 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 72 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 73 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 74 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 75 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 76 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 77 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 78 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 79 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 80 - protein, 48 aa, Artificial Sequence; identical to SEQ ID NO: 59
  Description of Artificial Sequence: Synthetic polypeptide

SEQ ID NO: 81 - protein, 48 aa, Artificial Sequence; identical to SEQ ID NO: 60
  Description of Artificial Sequence: Synthetic polypeptide

SEQ ID NO: 82 - protein, 8 aa, Artificial Sequence
  Description of Artificial Sequence: Synthetic peptide
LTPRSLLV

SEQ ID NO: 83 - protein, 8 aa, Artificial Sequence
  Description of Artificial Sequence: Synthetic peptide
LTPRSLLV

SEQ ID NO: 84 - protein, 8 aa, Artificial Sequence
  Description of Artificial Sequence: Synthetic peptide
KLTRVVGG

SEQ ID NO: 85 - protein, 8 aa, Artificial Sequence
  Description of Artificial Sequence: Synthetic peptide
TMTRIVGG

SEQ ID NO: 86 - protein, 8 aa, Artificial Sequence
  Description of Artificial Sequence: Synthetic peptide
SPFRSTGG

SEQ ID NO: 87 - protein, 8 aa, Artificial Sequence
  Description of Artificial Sequence: Synthetic peptide
LQVRIVGG

SEQ ID NO: 88 - protein, 8 aa, Artificial Sequence
  Description of Artificial Sequence: Synthetic peptide
PLGRIVGG

SEQ ID NO: 89 - protein, 8 aa, Artificial Sequence
  Description of Artificial Sequence: Synthetic peptide
IEGRTVGG

SEQ ID NO: 90 - protein, 8 aa, Artificial Sequence
  Description of Artificial Sequence: Synthetic peptide
LTPRSLLV

SEQ ID NO: 91 - protein, 8 aa, Artificial Sequence
  Description of Artificial Sequence: Synthetic peptide
LGPVSGVP

SEQ ID NO: 92 - protein, 8 aa, Artificial Sequence
  Description of Artificial Sequence: Synthetic peptide
VAGDSLEE

SEQ ID NO: 93 - protein, 8 aa, Artificial Sequence
  Description of Artificial Sequence: Synthetic peptide
GPAGLGGA

SEQ ID NO: 94 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 95 - protein, 8 aa, Artificial Sequence
  Description of Artificial Sequence: Synthetic peptide
GPAGLRGA

SEQ ID NO: 96 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 97 - protein, 8 aa, Artificial Sequence
  Description of Artificial Sequence: Synthetic peptide
APLGLRLR

SEQ ID NO: 98 - protein, 8 aa, Artificial Sequence
  Description of Artificial Sequence: Synthetic peptide
PALPLVAQ

SEQ ID NO: 99 - protein, 7 aa, Artificial Sequence
  Description of Artificial Sequence: Synthetic peptide
ENLYFQG

SEQ ID NO: 100 - protein, 8 aa, Artificial Sequence
  Description of Artificial Sequence: Synthetic peptide
ENLYFQGS

SEQ ID NO: 101 - protein, 8 aa, Artificial Sequence
  Description of Artificial Sequence: Synthetic peptide
DDDKIVGG

SEQ ID NO: 102 - protein, 8 aa, Artificial Sequence
  Description of Artificial Sequence: Synthetic peptide
DDDKIVGG

SEQ ID NO: 103 - protein, 8 aa, Artificial Sequence
  Description of Artificial Sequence: Synthetic peptide
LEVLFQGP

SEQ ID NO: 104 - protein, 8 aa, Artificial Sequence
  Description of Artificial Sequence: Synthetic peptide
LEVLFQGP

SEQ ID NO: 105 - protein, 8 aa, Artificial Sequence
  Description of Artificial Sequence: Synthetic peptide
LPKTGSES

SEQ ID NO: 106 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 107 - DNA, 144 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttct

SEQ ID NO: 108 - DNA, 144 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctct

SEQ ID NO: 109 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 110 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 111 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 112 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 113 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 114 - DNA, 1875 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 115 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 116 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 117 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 118 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 119 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 120 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 121 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 122 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 123 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 124 - DNA, 37 bp, Artificial Sequence
  Description of Artificial Sequence: Synthetic oligonucleotide
aggtgcaagcgcaagcggcgcgccaagcacgggaggt

SEQ ID NO: 125 - DNA, 37 bp, Artificial Sequence
  Description of Artificial Sequence: Synthetic oligonucleotide
aggtccagaaccaacggggccggccccaagcggaggt

SEQ ID NO: 126 - protein, 6 aa, Artificial Sequence
  Description of Artificial Sequence: Synthetic peptide
HHHHHH

SEQ ID NO: 127 - protein, 4 aa, Artificial Sequence
  Description of Artificial Sequence: Synthetic peptide
DDDK

SEQ ID NO: 128 - protein, 4 aa, Artificial Sequence
  Description of Artificial Sequence: Synthetic peptide
IDGR

SEQ ID NO: 129 - protein, 6 aa, Artificial Sequence
  Description of Artificial Sequence: Synthetic peptide
LVPRGS

SEQ ID NO: 130 - protein, 8 aa, Artificial Sequence
  Description of Artificial Sequence: Synthetic peptide
LEVLFQGP

SEQ ID NO: 131 - protein, 7 aa, Artificial Sequence
  Description of Artificial Sequence: Synthetic peptide
EQLYFQG

SEQ ID NO: 132 - protein, 7 aa, Artificial Sequence
  Description of Artificial Sequence: Synthetic peptide
ETLFQGP

SEQ ID NO: 133 - protein, 5 aa, Artificial Sequence
  Description of Artificial Sequence: Synthetic peptide
LPETG

SEQ ID NO: 134 - DNA, 147 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctcca

SEQ ID NO: 135 - DNA, 147 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctcca

SEQ ID NO: 136 - protein, 12 aa, Artificial Sequence
  Description of Artificial Sequence: Synthetic peptide
GESPGGSSGSES

SEQ ID NO: 137 - protein, 12 aa, Artificial Sequence
  Description of Artificial Sequence: Synthetic peptide
GSEGSSGPGESS

SEQ ID NO: 138 - protein, 12 aa, Artificial Sequence
  Description of Artificial Sequence: Synthetic peptide
GSSESGSSEGGP

SEQ ID NO: 139 - protein, 12 aa, Artificial Sequence
  Description of Artificial Sequence: Synthetic peptide
GSGGEPSESGSS

SEQ ID NO: 140 - DNA, 36 bp, Artificial Sequence
  Description of Artificial Sequence: Synthetic oligonucleotide
aggtgaatctccdggtggytcyagcggttcygartc

SEQ ID NO: 141 - DNA, 36 bp, Artificial Sequence
  Description of Artificial Sequence: Synthetic oligonucleotide
acctgaytcrgaaccgctrgarccacchggagattc

SEQ ID NO: 142 - DNA, 36 bp, Artificial Sequence
  Description of Artificial Sequence: Synthetic oligonucleotide
aggtagcgaaggttcttcyggtccdggygartcytc

SEQ ID NO: 143 - DNA, 36 bp, Artificial Sequence
  Description of Artificial Sequence: Synthetic oligonucleotide
acctgargaytcrcchggaccrgaagaaccttcgct

SEQ ID NO: 144 - DNA, 36 bp, Artificial Sequence
  Description of Artificial Sequence: Synthetic oligonucleotide
aggttcytcygaaagcggttcttcygarggyggtcc

SEQ ID NO: 145 - DNA, 36 bp, Artificial Sequence
  Description of Artificial Sequence: Synthetic oligonucleotide
acctggaccrccytcrgaagaaccgctttcrgarga

SEQ ID NO: 146 - DNA, 36 bp, Artificial Sequence
  Description of Artificial Sequence: Synthetic oligonucleotide
aggttcyggtggygaaccdtcygartctggtagctc

SEQ ID NO: 147 - DNA, 24 bp, Artificial Sequence
  Description of Artificial Sequence: Synthetic oligonucleotide
aggttcgtcttcactcgagggtac

SEQ ID NO: 148 - DNA, 16 bp, Artificial Sequence
  Description of Artificial Sequence: Synthetic oligonucleotide
cctcgagtgaagacga

SEQ ID NO: 149 - protein, 36 aa, Artificial Sequence
  Description of Artificial Sequence: Synthetic polypeptide
GSGGEPSESGSSGESPGGSSGSESGESPGGSSGSES

SEQ ID NO: 150 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 151 - protein, 36 aa, Artificial Sequence
  Description of Artificial Sequence: Synthetic polypeptide
GSEGSSGPGESSGESPGGSSGSESGSSESGSSEGGP

SEQ ID NO: 152 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 153 - protein, 36 aa, Artificial Sequence
  Description of Artificial Sequence: Synthetic polypeptide
GSSESGSSEGGPGSSESGSSEGGPGESPGGSSGSES

SEQ ID NO: 154 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 155 - protein, 36 aa, Artificial Sequence
  Description of Artificial Sequence: Synthetic polypeptide
GSGGEPSESGSSGSSESGSSEGGPGSGGEPSESGSS

SEQ ID NO: 156 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 157 - protein, 36 aa, Artificial Sequence
  Description of Artificial Sequence: Synthetic polypeptide
GSSESGSSEGGPGSEGSSGPGESSGSEGSSGPGESS

SEQ ID NO: 158 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 159 - protein, 36 aa, Artificial Sequence
  Description of Artificial Sequence: Synthetic polypeptide
GSSESGSSEGGPGESPGGSSGSESGSEGSSGPGESS

SEQ ID NO: 160 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 161 - protein, 36 aa, Artificial Sequence
  Description of Artificial Sequence: Synthetic polypeptide
GSGGEPSESGSSGSGGEPSESGSSGSEGSSGPGESS

SEQ ID NO: 162 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 163 - protein, 36 aa, Artificial Sequence
  Description of Artificial Sequence: Synthetic polypeptide
GSSESGSSEGGPGSEGSSGPGESSGESPGGSSGSES

SEQ ID NO: 164 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 165 - protein, 36 aa, Artificial Sequence
  Description of Artificial Sequence: Synthetic polypeptide
GSSESGSSEGGPGSSESGSSEGGPGSSESGSSEGGP

SEQ ID NO: 166 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 167 - protein, 36 aa, Artificial Sequence
  Description of Artificial Sequence: Synthetic polypeptide
GSGGEPSESGSSGSEGSSGPGESSGSSESGSSEGGP

SEQ ID NO: 168 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 169 - protein, 36 aa, Artificial Sequence; identical to SEQ ID NO: 155
  Description of Artificial Sequence: Synthetic polypeptide

SEQ ID NO: 170 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 171 - protein, 36 aa, Artificial Sequence
  Description of Artificial Sequence: Synthetic polypeptide
GSGGEPSESGSSGSSESGSSEGGPGESPGGSSGSES

SEQ ID NO: 172 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 173 - protein, 36 aa, Artificial Sequence
  Description of Artificial Sequence: Synthetic polypeptide
GSGGEPSESGSSGESPGGSSGSESGSEGSSGPGESS

SEQ ID NO: 174 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 175 - protein, 36 aa, Artificial Sequence
  Description of Artificial Sequence: Synthetic polypeptide
GSGGEPSESGSSGESPGGSSGSESGSGGEPSESGSS

SEQ ID NO: 176 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 177 - protein, 36 aa, Artificial Sequence; identical to SEQ ID NO: 165
  Description of Artificial Sequence: Synthetic polypeptide

SEQ ID NO: 178 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 179 - protein, 36 aa, Artificial Sequence
  Description of Artificial Sequence: Synthetic polypeptide
GESPGGSSGSESGSEGSSGPGESSGSEGSSGPGESS

SEQ ID NO: 180 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 181 - protein, 36 aa, Artificial Sequence
  Description of Artificial Sequence: Synthetic polypeptide
GSGGEPSESGSSGSGGEPSESGSSGSSESGSSEGGP

SEQ ID NO: 182 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 183 - protein, 36 aa, Artificial Sequence
  Description of Artificial Sequence: Synthetic polypeptide
GSGGEPSESGSSGSGGEPSESGSSGSGGEPSESGSS

SEQ ID NO: 184 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 185 - protein, 36 aa, Artificial Sequence
  Description of Artificial Sequence: Synthetic polypeptide
GSGGEPSESGSSGSSESGSSEGGPGSEGSSGPGESS

SEQ ID NO: 186 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 187 - protein, 36 aa, Artificial Sequence
  Description of Artificial Sequence: Synthetic polypeptide
GSGGEPSESGSSGSEGSSGPGESSGSGGEPSESGSS

SEQ ID NO: 188 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 189 - protein, 36 aa, Artificial Sequence; identical to SEQ ID NO: 175
  Description of Artificial Sequence: Synthetic polypeptide

SEQ ID NO: 190 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 191 - protein, 36 aa, Artificial Sequence
  Description of Artificial Sequence: Synthetic polypeptide
GSSESGSSEGGPGSGGEPSESGSSGSSESGSSEGGP

SEQ ID NO: 192 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 193 - protein, 36 aa, Artificial Sequence
  Description of Artificial Sequence: Synthetic polypeptide
GSEGSSGPGESSGESPGGSSGSESGSEGSSGPGESS

SEQ ID NO: 194 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 195 - protein, 36 aa, Artificial Sequence; identical to SEQ ID NO: 165
  Description of Artificial Sequence: Synthetic polypeptide

SEQ ID NO: 196 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 197 - protein, 36 aa, Artificial Sequence; identical to SEQ ID NO: 149
  Description of Artificial Sequence: Synthetic polypeptide

SEQ ID NO: 198 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 199 - protein, 36 aa, Artificial Sequence
  Description of Artificial Sequence: Synthetic polypeptide
GSGGEPSESGSSGSEGSSGPGESSGESPGGSSGSES

SEQ ID NO: 200 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 201 - protein, 36 aa, Artificial Sequence
  Description of Artificial Sequence: Synthetic polypeptide
GESPGGSSGSESGESPGGSSGSESGESPGGSSGSES

SEQ ID NO: 202 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 203 - protein, 36 aa, Artificial Sequence
  Description of Artificial Sequence: Synthetic polypeptide
GSEGSSGPGESSGSEGSSGPGESSGSGGEPSESGSS

SEQ ID NO: 204 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 205 - protein, 36 aa, Artificial Sequence; identical to SEQ ID NO: 199
  Description of Artificial Sequence: Synthetic polypeptide

SEQ ID NO: 206 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 207 - protein, 36 aa, Artificial Sequence; identical to SEQ ID NO: 155
  Description of Artificial Sequence: Synthetic polypeptide

SEQ ID NO: 208 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 209 - protein, 36 aa, Artificial Sequence
  Description of Artificial Sequence: Synthetic polypeptide
GSSESGSSEGGPGSGGEPSESGSSGSEGSSGPGESS

SEQ ID NO: 210 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 211 - protein, 36 aa, Artificial Sequence
  Description of Artificial Sequence: Synthetic polypeptide
GSGGEPSESGSSGSEGSSGPGESSGSEGSSGPGESS

SEQ ID NO: 212 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 213 - protein, 36 aa, Artificial Sequence; identical to SEQ ID NO: 155
  Description of Artificial Sequence: Synthetic polypeptide

SEQ ID NO: 214 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 215 - protein, 36 aa, Artificial Sequence; identical to SEQ ID NO: 149
  Description of Artificial Sequence: Synthetic polypeptide

SEQ ID NO: 216 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 217 - protein, 36 aa, Artificial Sequence
  Description of Artificial Sequence: Synthetic polypeptide
GSGGEPSESGSSGSGGEPSESGSSGESPGGSSGSES

SEQ ID NO: 218 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 219 - protein, 36 aa, Artificial Sequence
  Description of Artificial Sequence: Synthetic polypeptide
GSEGSSGPGESSGSSESGSSEGGPGSEGSSGPGESS

SEQ ID NO: 220 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 221 - protein, 36 aa, Artificial Sequence
  Description of Artificial Sequence: Synthetic polypeptide
GSSESGSSEGGPGESPGGSSGSESGESPGGSSGSES

SEQ ID NO: 222 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 223 - protein, 36 aa, Artificial Sequence; identical to SEQ ID NO: 203
  Description of Artificial Sequence: Synthetic polypeptide

SEQ ID NO: 224 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 225 - protein, 12 aa, Artificial Sequence
  Description of Artificial Sequence: Synthetic peptide
GSPAGSPTSTEE

SEQ ID NO: 226 - protein, 12 aa, Artificial Sequence
  Description of Artificial Sequence: Synthetic peptide
GSEPATSGSETP

SEQ ID NO: 227 - protein, 12 aa, Artificial Sequence
  Description of Artificial Sequence: Synthetic peptide
GTSESATPESGP

SEQ ID NO: 228 - protein, 12 aa, Artificial Sequence
  Description of Artificial Sequence: Synthetic peptide
GTSTEPSEGSAP

SEQ ID NO: 229 - DNA, 36 bp, Artificial Sequence
  Description of Artificial Sequence: Synthetic oligonucleotide
aggtagcccdgcwggytctccdacytcyacygarga

SEQ ID NO: 230 - DNA, 36 bp, Artificial Sequence
  Description of Artificial Sequence: Synthetic oligonucleotide
accttcytcrgtrgargthggagarccwgchgggct

SEQ ID NO: 231 - DNA, 36 bp, Artificial Sequence
  Description of Artificial Sequence: Synthetic oligonucleotide
aggtagcgaacckgcwacytcyggytctgaracycc

SEQ ID NO: 232 - DNA, 36 bp, Artificial Sequence
  Description of Artificial Sequence: Synthetic oligonucleotide
acctggrgtytcagarccrgargtwgcmggttcgct

SEQ ID NO: 233 - DNA, 36 bp, Artificial Sequence
  Description of Artificial Sequence: Synthetic oligonucleotide
aggtacytctgaaagcgcwacycckgartcyggycc

SEQ ID NO: 234 - DNA, 36 bp, Artificial Sequence
  Description of Artificial Sequence: Synthetic oligonucleotide
acctggrccrgaytcmggrgtwgcgctttcagargt

SEQ ID NO: 235 - DNA, 36 bp, Artificial Sequence
  Description of Artificial Sequence: Synthetic oligonucleotide
aggtacytctacygaaccktcygarggyagcgcwcc

SEQ ID NO: 236 - DNA, 36 bp, Artificial Sequence
  Description of Artificial Sequence: Synthetic oligonucleotide
acctggwgcgctrccytcrgamggttcrgtagargt

SEQ ID NO: 237 - DNA, 24 bp, Artificial Sequence
  Description of Artificial Sequence: Synthetic oligonucleotide
aggttcgtcttcactcgagggtac

SEQ ID NO: 238 - DNA, 16 bp, Artificial Sequence
  Description of Artificial Sequence: Synthetic oligonucleotide
cctcgagtgaagacga

SEQ ID NO: 239 - protein, 36 aa, Artificial Sequence
  Description of Artificial Sequence: Synthetic polypeptide
GSPAGSPTSTEEGTSESATPESGPGTSTEPSEGSAP

SEQ ID NO: 240 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 241 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 242 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 243 - protein, 36 aa, Artificial Sequence
  Description of Artificial Sequence: Synthetic polypeptide
GTSTEPSEGSAPGTSESATPESGPGTSESATPESGP

SEQ ID NO: 244 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 245 - protein, 36 aa, Artificial Sequence; identical to SEQ ID NO: 243
  Description of Artificial Sequence: Synthetic polypeptide

SEQ ID NO: 246 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 247 - protein, 36 aa, Artificial Sequence
  Description of Artificial Sequence: Synthetic polypeptide
GSEPATSGSETPGTSESATPESGPGSPAGSPTSTEE

SEQ ID NO: 248 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 249 - protein, 36 aa, Artificial Sequence
  Description of Artificial Sequence: Synthetic polypeptide
GTSESATPESGPGSEPATSGSETPGTSTEPSEGSAP

SEQ ID NO: 250 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 251 - protein, 36 aa, Artificial Sequence
  Description of Artificial Sequence: Synthetic polypeptide
GSPAGSPTSTEEGSPAGSPTSTEEGSEPATSGSETP

SEQ ID NO: 252 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 253 - protein, 36 aa, Artificial Sequence; identical to SEQ ID NO: 239
  Description of Artificial Sequence: Synthetic polypeptide

SEQ ID NO: 254 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 255 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 256 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 257 - protein, 36 aa, Artificial Sequence
  Description of Artificial Sequence: Synthetic polypeptide
GTSESATPESGPGTSTEPSEGSAPGTSTEPSEGSAP

SEQ ID NO: 258 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 259 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 260 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 261 - protein, 36 aa, Artificial Sequence
  Description of Artificial Sequence: Synthetic polypeptide
GSEPATSGSETPGSPAGSPTSTEEGTSESATPESGP

SEQ ID NO: 262 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 263 - protein, 36 aa, Artificial Sequence; identical to SEQ ID NO: 243
  Description of Artificial Sequence: Synthetic polypeptide

SEQ ID NO: 264 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 265 - protein, 36 aa, Artificial Sequence
  Description of Artificial Sequence: Synthetic polypeptide
GTSTEPSEGSAPGSEPATSGSETPGSPAGSPTSTEE

SEQ ID NO: 266 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 267 - protein, 36 aa, Artificial Sequence
  Description of Artificial Sequence: Synthetic polypeptide
GSPAGSPTSTEEGTSESATPESGPGSEPATSGSETP

SEQ ID NO: 268 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 269 - protein, 36 aa, Artificial Sequence
  Description of Artificial Sequence: Synthetic polypeptide
GTSESATPESGPGSPAGSPTSTEEGSPAGSPTSTEE

SEQ ID NO: 270 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 271 - protein, 36 aa, Artificial Sequence
  Description of Artificial Sequence: Synthetic polypeptide
GTSTEPSEGSAPGTSESATPESGPGTSTEPSEGSAP

SEQ ID NO: 272 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 273 - protein, 36 aa, Artificial Sequence
  Description of Artificial Sequence: Synthetic polypeptide
GSPAGSPTSTEEGTSTEPSEGSAPGSEPATSGSETP

SEQ ID NO: 274 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 275 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 276 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 277 - protein, 36 aa, Artificial Sequence; identical to SEQ ID NO: 247
  Description of Artificial Sequence: Synthetic polypeptide

SEQ ID NO: 278 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 279 - protein, 36 aa, Artificial Sequence; identical to SEQ ID NO: 257
  Description of Artificial Sequence: Synthetic polypeptide

SEQ ID NO: 280 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 281 - protein, 36 aa, Artificial Sequence; identical to SEQ ID NO: 275
  Description of Artificial Sequence: Synthetic polypeptide

SEQ ID NO: 282 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 283 - protein, 36 aa, Artificial Sequence; identical to SEQ ID NO: 241
  Description of Artificial Sequence: Synthetic polypeptide

SEQ ID NO: 284 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 285 - protein, 36 aa, Artificial Sequence
  Description of Artificial Sequence: Synthetic polypeptide
GSEPATSGSETPGTSESATPESGPGTSTEPSEGSAP

SEQ ID NO: 286 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 287 - protein, 36 aa, Artificial Sequence; identical to SEQ ID NO: 259
  Description of Artificial Sequence: Synthetic polypeptide

SEQ ID NO: 288 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 289 - protein, 36 aa, Artificial Sequence
  Description of Artificial Sequence: Synthetic polypeptide
GSEPATSGSETPGTSESATPESGPGSEPATSGSETP

SEQ ID NO: 290 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 291 - protein, 36 aa, Artificial Sequence; identical to SEQ ID NO: 289
  Description of Artificial Sequence: Synthetic polypeptide

SEQ ID NO: 292 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 293 - protein, 36 aa, Artificial Sequence
  Description of Artificial Sequence: Synthetic polypeptide
GSEPATSGSETPGSEPATSGSETPGTSTEPSEGSAP

SEQ ID NO: 294 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 295 - protein, 36 aa, Artificial Sequence
  Description of Artificial Sequence: Synthetic polypeptide
GTSESATPESGPGSEPATSGSETPGSEPATSGSETP

SEQ ID NO: 296 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 297 - protein, 36 aa, Artificial Sequence
  Description of Artificial Sequence: Synthetic polypeptide
GTSTEPSEGSAPGTSTEPSEGSAPGTSESATPESGP

SEQ ID NO: 298 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 299 - protein, 36 aa, Artificial Sequence
  Description of Artificial Sequence: Synthetic polypeptide
GSEPATSGSETPGTSESATPESGPGTSESATPESGP

SEQ ID NO: 300 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 301 - protein, 36 aa, Artificial Sequence; identical to SEQ ID NO: 293
  Description of Artificial Sequence: Synthetic polypeptide

SEQ ID NO: 302 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 303 - protein, 36 aa, Artificial Sequence
  Description of Artificial Sequence: Synthetic polypeptide
GSEPATSGSETPGTSTEPSEGSAPGSEPATSGSETP

SEQ ID NO: 304 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 305 - protein, 36 aa, Artificial Sequence
  Description of Artificial Sequence: Synthetic polypeptide
GTSTEPSEGSAPGTSTEPSEGSAPGSEPATSGSETP

SEQ ID NO: 306 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 307 - protein, 36 aa, Artificial Sequence; identical to SEQ ID NO: 265
  Description of Artificial Sequence: Synthetic polypeptide

SEQ ID NO: 308 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 309 - protein, 36 aa, Artificial Sequence; identical to SEQ ID NO: 261
  Description of Artificial Sequence: Synthetic polypeptide

SEQ ID NO: 310 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 311 - protein, 36 aa, Artificial Sequence
  Description of Artificial Sequence: Synthetic polypeptide
GTSESATPESGPGSEPATSGSETPGTSESATPESGP

SEQ ID NO: 312 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 313 - protein, 12 aa, Artificial Sequence
  Description of Artificial Sequence: Synthetic peptide
GSTSESPSGTAP

SEQ ID NO: 314 - protein, 12 aa, Artificial Sequence
  Description of Artificial Sequence: Synthetic peptide
GTSTPESGSASP

SEQ ID NO: 315 - protein, 12 aa, Artificial Sequence
  Description of Artificial Sequence: Synthetic peptide
GTSPSGESSTAP

SEQ ID NO: 316 - protein, 12 aa, Artificial Sequence
  Description of Artificial Sequence: Synthetic peptide
GSTSSTAESPGP

SEQ ID NO: 317 - DNA, 36 bp, Artificial Sequence
  Description of Artificial Sequence: Synthetic oligonucleotide
aggttctacyagcgaatcyccktctggyacygcwcc

SEQ ID NO: 318 - DNA, 36 bp, Artificial Sequence
  Description of Artificial Sequence: Synthetic oligonucleotide
acctggwgcrgtrccagamggrgattcgctrgtaga

SEQ ID NO: 319 - DNA, 36 bp, Artificial Sequence
  Description of Artificial Sequence: Synthetic oligonucleotide
aggtacytctacycckgaaagcggytcygcwtctcc

SEQ ID NO: 320 - DNA, 36 bp, Artificial Sequence
  Description of Artificial Sequence: Synthetic oligonucleotide
acctggagawgcrgarccgctttcmggrgtagargt

SEQ ID NO: 321 - DNA, 36 bp, Artificial Sequence
  Description of Artificial Sequence: Synthetic oligonucleotide
aggtacytcycckagcggygaatcttctacygcwcc

SEQ ID NO: 322 - DNA, 36 bp, Artificial Sequence
  Description of Artificial Sequence: Synthetic oligonucleotide
acctggwgcrgtagaagattcrccgctmggrgargt

SEQ ID NO: 323 - DNA, 36 bp, Artificial Sequence
  Description of Artificial Sequence: Synthetic oligonucleotide
aggttcyacyagctctacygcwgaatctcckggycc

SEQ ID NO: 324 - DNA, 36 bp, Artificial Sequence
  Description of Artificial Sequence: Synthetic oligonucleotide
acctggrccmggagattcwgcrgtagagctrgtrga

SEQ ID NO: 325 - DNA, 24 bp, Artificial Sequence
  Description of Artificial Sequence: Synthetic oligonucleotide
aggttcgtcttcactcgagggtac

SEQ ID NO: 326 - DNA, 16 bp, Artificial Sequence
  Description of Artificial Sequence: Synthetic oligonucleotide
cctcgagtgaagacga

SEQ ID NO: 327 - protein, 36 aa, Artificial Sequence
  Description of Artificial Sequence: Synthetic polypeptide
GTSTPESGSASPGTSPSGESSTAPGTSPSGESSTAP

SEQ ID NO: 328 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 329 - protein, 36 aa, Artificial Sequence
  Description of Artificial Sequence: Synthetic polypeptide
GTSPSGESSTAPGSTSSTAESPGPGTSPSGESSTAP

SEQ ID NO: 330 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 331 - protein, 36 aa, Artificial Sequence
  Description of Artificial Sequence: Synthetic polypeptide
GSTSSTAESPGPGTSPSGESSTAPGTSTPESGSASP

SEQ ID NO: 332 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 333 - protein, 36 aa, Artificial Sequence
  Description of Artificial Sequence: Synthetic polypeptide
GSTSSTAESPGPGSTSSTAESPGPGTSPSGESSTAP

SEQ ID NO: 334 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 335 - protein, 36 aa, Artificial Sequence; identical to SEQ ID NO: 331
  Description of Artificial Sequence: Synthetic polypeptide

SEQ ID NO: 336 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 337 - protein, 36 aa, Artificial Sequence
  Description of Artificial Sequence: Synthetic polypeptide
GSTSSTAESPGPGTSTPESGSASPGSTSESPSGTAP

SEQ ID NO: 338 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 339 - protein, 36 aa, Artificial Sequence
  Description of Artificial Sequence: Synthetic polypeptide
GSTSSTAESPGPGTSTPESGSASPGTSTPESGSASP

SEQ ID NO: 340 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 341 - protein, 36 aa, Artificial Sequence
  Description of Artificial Sequence: Synthetic polypeptide
GSTSESPSGTAPGTSPSGESSTAPGSTSESPSGTAP

SEQ ID NO: 342 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 343 - protein, 36 aa, Artificial Sequence; identical to SEQ ID NO: 333
  Description of Artificial Sequence: Synthetic polypeptide

SEQ ID NO: 344 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 345 - protein, 36 aa, Artificial Sequence; identical to SEQ ID NO: 337
  Description of Artificial Sequence: Synthetic polypeptide

SEQ ID NO: 346 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 347 - protein, 36 aa, Artificial Sequence; identical to SEQ ID NO: 333
  Description of Artificial Sequence: Synthetic polypeptide

SEQ ID NO: 348 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 349 - protein, 36 aa, Artificial Sequence
  Description of Artificial Sequence: Synthetic polypeptide
GSTSSTAESPGPGSTSESPSGTAPGSTSSTAESPGP

SEQ ID NO: 350 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 351 - protein, 36 aa, Artificial Sequence
  Description of Artificial Sequence: Synthetic polypeptide
GSTSSTAESPGPGSTSSTAESPGPGSTSSTAESPGP

SEQ ID NO: 352 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 353 - protein, 36 aa, Artificial Sequence
  Description of Artificial Sequence: Synthetic polypeptide
GSTSESPSGTAPGSTSSTAESPGPGSTSSTAESPGP

SEQ ID NO: 354 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 355 - protein, 36 aa, Artificial Sequence
  Description of Artificial Sequence: Synthetic polypeptide
GSTSESPSGTAPGSTSESPSGTAPGSTSESPSGTAP

SEQ ID NO: 356 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 357 - protein, 36 aa, Artificial Sequence; identical to SEQ ID NO: 351
  Description of Artificial Sequence: Synthetic polypeptide

SEQ ID NO: 358 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 359 - protein, 36 aa, Artificial Sequence; identical to SEQ ID NO: 333
  Description of Artificial Sequence: Synthetic polypeptide

SEQ ID NO: 360 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 361 - protein, 36 aa, Artificial Sequence
  Description of Artificial Sequence: Synthetic polypeptide
GSSPSASTGTGPGSSTPSGATGSPGSSTPSGATGSP

SEQ ID NO: 362 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 363 - protein, 36 aa, Artificial Sequence
  Description of Artificial Sequence: Synthetic polypeptide
GTSPSGESSTAPGTSTPESGSASPGSTSSTAESPGP

SEQ ID NO: 364 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 365 - protein, 36 aa, Artificial Sequence
  Description of Artificial Sequence: Synthetic polypeptide
GSTSSTAESPGPGSTSSTAESPGPGTSTPESGSASP

SEQ ID NO: 366 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 367 - protein, 36 aa, Artificial Sequence
  Description of Artificial Sequence: Synthetic polypeptide
GTSPSGESSTAPGSTSSTAESPGPGTSTPESGSASP

SEQ ID NO: 368 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 369 - protein, 36 aa, Artificial Sequence; identical to SEQ ID NO: 353
  Description of Artificial Sequence: Synthetic polypeptide

SEQ ID NO: 370 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 371 - protein, 36 aa, Artificial Sequence; identical to SEQ ID NO: 349
  Description of Artificial Sequence: Synthetic polypeptide

SEQ ID NO: 372 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 373 - protein, 36 aa, Artificial Sequence; identical to SEQ ID NO: 331
  Description of Artificial Sequence: Synthetic polypeptide

SEQ ID NO: 374 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 375 - protein, 36 aa, Artificial Sequence
  Description of Artificial Sequence: Synthetic polypeptide
GSTSESPSGTAPGSTSESPSGTAPGTSPSGESSTAP

SEQ ID NO: 376 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 377 - protein, 36 aa, Artificial Sequence
  Description of Artificial Sequence: Synthetic polypeptide
GSTSESPSGTAPGSTSESPSGTAPGTSTPESGSASP

SEQ ID NO: 378 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 379 - protein, 36 aa, Artificial Sequence
  Description of Artificial Sequence: Synthetic polypeptide
GTSTPESGSASPGSTSSTAESPGPGSTSSTAESPGP

SEQ ID NO: 380 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 381 - protein, 36 aa, Artificial Sequence; identical to SEQ ID NO: 375
  Description of Artificial Sequence: Synthetic polypeptide

SEQ ID NO: 382 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 383 - protein, 36 aa, Artificial Sequence
  Description of Artificial Sequence: Synthetic polypeptide
GSTSSTAESPGPGSTSSTAESPGPGSTSESPSGTAP

SEQ ID NO: 384 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 385 - protein, 36 aa, Artificial Sequence; identical to SEQ ID NO: 365
  Description of Artificial Sequence: Synthetic polypeptide

SEQ ID NO: 386 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 387 - protein, 36 aa, Artificial Sequence; identical to SEQ ID NO: 383
  Description of Artificial Sequence: Synthetic polypeptide

SEQ ID NO: 388 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 389 - protein, 36 aa, Artificial Sequence
  Description of Artificial Sequence: Synthetic polypeptide
GTSPSGESSTAPGSTSESPSGTAPGSTSSTAESPGP

SEQ ID NO: 390 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 391 - protein, 36 aa, Artificial Sequence
  Description of Artificial Sequence: Synthetic polypeptide
GSTSESPSGTAPGTSPSGESSTAPGSTSSTAESPGP

SEQ ID NO: 392 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 393 - protein, 36 aa, Artificial Sequence
  Description of Artificial Sequence: Synthetic polypeptide
GSTSSTAESPGPGSTSESPSGTAPGTSPSGESSTAP

SEQ ID NO: 394 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 395 - protein, 36 aa, Artificial Sequence; identical to SEQ ID NO: 377
  Description of Artificial Sequence: Synthetic polypeptide

SEQ ID NO: 396 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 397 - protein, 36 aa, Artificial Sequence
  Description of Artificial Sequence: Synthetic polypeptide
GTSTPESGSASPGSTSESPSGTAPGSTSSTAESPGP

SEQ ID NO: 398 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 399 - protein, 36 aa, Artificial Sequence
  Description of Artificial Sequence: Synthetic polypeptide
GSTSSTAESPGPGTSPSGESSTAPGTSPSGESSTAP

SEQ ID NO: 400 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 401 - protein, 36 aa, Artificial Sequence
  Description of Artificial Sequence: Synthetic polypeptide
GTSPSGESSTAPGTSPSGESSTAPGTSPSGESSTAP

SEQ ID NO: 402 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 403 - protein, 36 aa, Artificial Sequence; identical to SEQ ID NO: 337
  Description of Artificial Sequence: Synthetic polypeptide

SEQ ID NO: 404 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 405 - protein, 36 aa, Artificial Sequence
  Description of Artificial Sequence: Synthetic polypeptide
GSTSESPSGTAPGTSPSGESSTAPGTSPSGESSTAP

SEQ ID NO: 406 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 407 - protein, 36 aa, Artificial Sequence
  Description of Artificial Sequence: Synthetic polypeptide
GSTSESPSGTAPGTSTPESGSASPGSTSSTAESPGP

SEQ ID NO: 408 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 409 - protein, 36 aa, Artificial Sequence; identical to SEQ ID NO: 383
  Description of Artificial Sequence: Synthetic polypeptide

SEQ ID NO: 410 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 411 - protein, 36 aa, Artificial Sequence
  Description of Artificial Sequence: Synthetic polypeptide
GSTSESPSGTAPGTSTPESGSASPGTSTPESGSASP

SEQ ID NO: 412 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 413 - protein, 36 aa, Artificial Sequence; identical to SEQ ID NO: 411
  Description of Artificial Sequence: Synthetic polypeptide

SEQ ID NO: 414 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 415 - protein, 12 aa, Artificial Sequence
  Description of Artificial Sequence: Synthetic peptide
GTPGSGTASSSP

SEQ ID NO: 416 - protein, 12 aa, Artificial Sequence
  Description of Artificial Sequence: Synthetic peptide
GSSTPSGATGSP

SEQ ID NO: 417 - protein, 12 aa, Artificial Sequence
  Description of Artificial Sequence: Synthetic peptide
GSSPSASTGTGP

SEQ ID NO: 418 - protein, 12 aa, Artificial Sequence
  Description of Artificial Sequence: Synthetic peptide
GASPGTSSTGSP

SEQ ID NO: 419 - DNA, 36 bp, Artificial Sequence
  Description of Artificial Sequence: Synthetic oligonucleotide
aggtacycckggyagcggtacygcwtcttcytctcc

SEQ ID NO: 420 - DNA, 36 bp, Artificial Sequence
  Description of Artificial Sequence: Synthetic oligonucleotide
acctggagargaagawgcrgtaccgctrccmggrgt

SEQ ID NO: 421 - DNA, 36 bp, Artificial Sequence
  Description of Artificial Sequence: Synthetic oligonucleotide
aggtagctctacyccktctggtgcwacyggytcycc

SEQ ID NO: 422 - DNA, 36 bp, Artificial Sequence
  Description of Artificial Sequence: Synthetic oligonucleotide
acctggrgarccrgtwgcaccagamggrgtagagct

SEQ ID NO: 423 - DNA, 36 bp, Artificial Sequence
  Description of Artificial Sequence: Synthetic oligonucleotide
aggttctagcccktctgcwtcyacyggtacyggycc

SEQ ID NO: 424 - DNA, 36 bp, Artificial Sequence
  Description of Artificial Sequence: Synthetic oligonucleotide
acctggrccrgtaccrgtrgawgcagamgggctaga

SEQ ID NO: 425 - DNA, 36 bp, Artificial Sequence
  Description of Artificial Sequence: Synthetic oligonucleotide
aggtgcwtcycckggyacyagctctacyggttctcc

SEQ ID NO: 426 - DNA, 36 bp, Artificial Sequence
  Description of Artificial Sequence: Synthetic oligonucleotide
acctggagaaccrgtagagctrgtrccmggrgawgc

SEQ ID NO: 427 - DNA, 24 bp, Artificial Sequence
  Description of Artificial Sequence: Synthetic oligonucleotide
aggttcgtcttcactcgagggtac

SEQ ID NO: 428 - DNA, 16 bp, Artificial Sequence
  Description of Artificial Sequence: Synthetic oligonucleotide
cctcgagtgaagacga

SEQ ID NO: 429 - protein, 36 aa, Artificial Sequence
  Description of Artificial Sequence: Synthetic polypeptide
GASPGTSSTGSPGTPGSGTASSSPGSSTPSGATGSP

SEQ ID NO: 430 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 431 - protein, 36 aa, Artificial Sequence
  Description of Artificial Sequence: Synthetic polypeptide
GSSTPSGATGSPGSSPSASTGTGPGSSTPSGATGSP

SEQ ID NO: 432 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 433 - protein, 36 aa, Artificial Sequence
  Description of Artificial Sequence: Synthetic polypeptide
GASPGTSSTGSPGSSPSASTGTGPGSSTPSGATGSP

SEQ ID NO: 434 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 435 - protein, 36 aa, Artificial Sequence
  Description of Artificial Sequence: Synthetic polypeptide
GTPGSGTASSSPGSSTPSGATGSPGASPGTSSTGSP

SEQ ID NO: 436 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 437 - protein, 36 aa, Artificial Sequence
  Description of Artificial Sequence: Synthetic polypeptide
GTPGSGTASSSPGASPGTSSTGSPGSRPSASTGTGP

SEQ ID NO: 438 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 439 - protein, 36 aa, Artificial Sequence
  Description of Artificial Sequence: Synthetic polypeptide
GASPGTSSTGSPGSSTPSGATGSPGASPGTSSTGSP

SEQ ID NO: 440 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 441 - protein, 36 aa, Artificial Sequence
  Description of Artificial Sequence: Synthetic polypeptide
GTPGSGTASSSPGSSTPSGATGSPGSSTPSGATGSP

SEQ ID NO: 442 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 443 - protein, 36 aa, Artificial Sequence
  Description of Artificial Sequence: Synthetic polypeptide
GASPGTSSTGSPGASPGTSSTGSPGASPGTSSTGSP

SEQ ID NO: 444 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 445 - protein, 36 aa, Artificial Sequence
  Description of Artificial Sequence: Synthetic polypeptide
GSSTPSGATGSPGSSPSASTGTGPGASPGTSSTGSP

SEQ ID NO: 446 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 447 - protein, 36 aa, Artificial Sequence
  Description of Artificial Sequence: Synthetic polypeptide
GSSTPSGATGSPGSSTPSGATGSPGTPGSGTASSSP

SEQ ID NO: 448 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 449 - protein, 36 aa, Artificial Sequence
  Description of Artificial Sequence: Synthetic polypeptide
GSSTPSGATGSPGSSTPSGATGSPGASPGTSSTGSP

SEQ ID NO: 450 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 451 - protein, 36 aa, Artificial Sequence
  Description of Artificial Sequence: Synthetic polypeptide
GTPGSGTASSSPGSSPSASTGTGPGSSTPSGATGSP

SEQ ID NO: 452 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 453 - protein, 36 aa, Artificial Sequence
  Description of Artificial Sequence: Synthetic polypeptide
GASPGTSSTGSPGSSPSASTGTGPGTPGSGTASSSP

SEQ ID NO: 454 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 455 - protein, 36 aa, Artificial Sequence; identical to SEQ ID NO: 449
  Description of Artificial Sequence: Synthetic polypeptide

SEQ ID NO: 456 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 457 - protein, 36 aa, Artificial Sequence
  Description of Artificial Sequence: Synthetic polypeptide
GTPGSGTASSSPGSSTPSGATGSPGSSPSASTGTGP

SEQ ID NO: 458 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 459 - protein, 36 aa, Artificial Sequence
  Description of Artificial Sequence: Synthetic polypeptide
GSSTPSGATGSPGTPGSGTASSSPGTPGSGTASSSP

SEQ ID NO: 460 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 461 - protein, 36 aa, Artificial Sequence; identical to SEQ ID NO: 435
  Description of Artificial Sequence: Synthetic polypeptide

SEQ ID NO: 462 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 463 - protein, 36 aa, Artificial Sequence; identical to SEQ ID NO: 449
  Description of Artificial Sequence: Synthetic polypeptide

SEQ ID NO: 464 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 465 - protein, 36 aa, Artificial Sequence; identical to SEQ ID NO: 429
  Description of Artificial Sequence: Synthetic polypeptide

SEQ ID NO: 466 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 467 - protein, 36 aa, Artificial Sequence
  Description of Artificial Sequence: Synthetic polypeptide
GSSPSASTGTGPGSSTPSGATGSPGTPGSGTASSSP

SEQ ID NO: 468 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 469 - protein, 36 aa, Artificial Sequence; identical to SEQ ID NO: 433
  Description of Artificial Sequence: Synthetic polypeptide

SEQ ID NO: 470 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 471 - protein, 36 aa, Artificial Sequence
  Description of Artificial Sequence: Synthetic polypeptide
GASPGTSSTGSPGSSTPSGATGSPGSSTPSGATGSP

SEQ ID NO: 472 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 473 - protein, 36 aa, Artificial Sequence
  Description of Artificial Sequence: Synthetic polypeptide
GTPGSGTASSSPGSSTPSGATGSPGTPGSGTASSSP

SEQ ID NO: 474 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 475 - protein, 36 aa, Artificial Sequence; identical to SEQ ID NO: 361
  Description of Artificial Sequence: Synthetic polypeptide

SEQ ID NO: 476 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 477 - protein, 36 aa, Artificial Sequence
  Description of Artificial Sequence: Synthetic polypeptide
GASPGTSSTGSPGSSPSASTGTGPGSSPSASTGTGP

SEQ ID NO: 478 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 479 - protein, 36 aa, Artificial Sequence
  Description of Artificial Sequence: Synthetic polypeptide
GTPGSGTASSSPGASPGTSSTGSPGASPGTSSTGSP

SEQ ID NO: 480 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 481 - protein, 36 aa, Artificial Sequence
  Description of Artificial Sequence: Synthetic polypeptide
GSSTPSGATGSPGASPGTSSTGSPGSSTPSGATGSP

SEQ ID NO: 482 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 483 - protein, 36 aa, Artificial Sequence
  Description of Artificial Sequence: Synthetic polypeptide
GSSTPSGATGSPGTPGSGTASSSPGSSTPSGATGSP

SEQ ID NO: 484 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 485 - protein, 36 aa, Artificial Sequence; identical to SEQ ID NO: 433
  Description of Artificial Sequence: Synthetic polypeptide

SEQ ID NO: 486 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 487 - protein, 36 aa, Artificial Sequence
  Description of Artificial Sequence: Synthetic polypeptide
GSSTPSGATGSPGSSTPSGATGSPGSSTPSGATGSP

SEQ ID NO: 488 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 489 - protein, 36 aa, Artificial Sequence
  Description of Artificial Sequence: Synthetic polypeptide
GASPGTSSTGSPGTPGSGTASSSPGASPGTSSTGSP

SEQ ID NO: 490 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 491 - protein, 36 aa, Artificial Sequence; identical to SEQ ID NO: 445
  Description of Artificial Sequence: Synthetic polypeptide

SEQ ID NO: 492 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 493 - protein, 36 aa, Artificial Sequence
  Description of Artificial Sequence: Synthetic polypeptide
GASPGTSSTGSPGSSTPSGATGSPGSSPSASTGTGP

SEQ ID NO: 494 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 495 - protein, 36 aa, Artificial Sequence; identical to SEQ ID NO: 435
  Description of Artificial Sequence: Synthetic polypeptide

SEQ ID NO: 496 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 497 - protein, 36 aa, Artificial Sequence; identical to SEQ ID NO: 483
  Description of Artificial Sequence: Synthetic polypeptide

SEQ ID NO: 498 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 499 - protein, 36 aa, Artificial Sequence
  Description of Artificial Sequence: Synthetic polypeptide
GSSPSASTGTGPGSSPSASTGTGPGASPGTSSTGSP

SEQ ID NO: 500 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 501 - protein, 36 aa, Artificial Sequence
  Description of Artificial Sequence: Synthetic polypeptide
GTPGSGTASSSPGSSTPSGATGSPGSNPSASTGTGP

SEQ ID NO: 502 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 503 - protein, 36 aa, Artificial Sequence
  Description of Artificial Sequence: Synthetic polypeptide
GSSPSASTGTGPGSSTPSGATGSPGASPGTSSTGSP

SEQ ID NO: 504 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 505 - protein, 36 aa, Artificial Sequence
  Description of Artificial Sequence: Synthetic polypeptide
GSSTPSGATGSPGASPGTSSTGSPGTPGSGTASSSP

SEQ ID NO: 506 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 507 - protein, 36 aa, Artificial Sequence; identical to SEQ ID NO: 487
  Description of Artificial Sequence: Synthetic polypeptide

SEQ ID NO: 508 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 509 - protein, 36 aa, Artificial Sequence; identical to SEQ ID NO: 429
  Description of Artificial Sequence: Synthetic polypeptide

SEQ ID NO: 510 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 511 - protein, 36 aa, Artificial Sequence
  Description of Artificial Sequence: Synthetic polypeptide
GSSTPSGATGSPGSSPSASTGTGPGSSPSASTGTGP

SEQ ID NO: 512 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 513 - protein, 36 aa, Artificial Sequence; identical to SEQ ID NO: 477
  Description of Artificial Sequence: Synthetic polypeptide

SEQ ID NO: 514 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 515 - protein, 36 aa, Artificial Sequence; identical to SEQ ID NO: 453
  Description of Artificial Sequence: Synthetic polypeptide

SEQ ID NO: 516 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 517 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 518 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 519 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 520 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 521 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 522 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 523 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 524 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 525 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 526 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 527 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 528 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 529 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 530 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 531 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 532 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 533 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 534 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 535 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 536 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 537 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 538 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 539 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 540 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 541 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 542 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 543 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 544 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 545 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 546 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 547 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 548 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 549 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 550 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 551 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 552 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 553 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 554 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 555 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 556 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 557 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 558 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 559 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 560 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 561 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 562 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 563 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 564 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 565 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 566 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 567 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 568 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 569 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 570 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 571 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 572 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 573 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 574 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 575 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 576 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 577 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 578 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 579 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 580 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 581 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 582 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 583 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 584 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 585 - protein, 11 aa, Artificial Sequence
  Description of Artificial Sequence: Synthetic peptide
GASASGAPSTG

SEQ ID NO: 586 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 587 - DNA, 49 bp, Artificial Sequence
  Description of Artificial Sequence: Synthetic oligonucleotide
cctcgagtgaagacgaacctccgcttggggccggccccgttggttctgg

SEQ ID NO: 588 - protein, 11 aa, Artificial Sequence
  Description of Artificial Sequence: Synthetic peptide
GPEPTGPAPSG

SEQ ID NO: 589 - protein, 13 aa, Artificial Sequence
  Description of Artificial Sequence: Synthetic peptide
MASPAGSPTSTEE

SEQ ID NO: 590 - protein, 13 aa, Artificial Sequence
  Description of Artificial Sequence: Synthetic peptide
MATSESATPESGP

SEQ ID NO: 591 - protein, 13 aa, Artificial Sequence
  Description of Artificial Sequence: Synthetic peptide
MATSPSGESSTAP

SEQ ID NO: 592 - protein, 13 aa, Artificial Sequence
  Description of Artificial Sequence: Synthetic peptide
MESTSSTAESPGP

SEQ ID NO: 593 - protein, 13 aa, Artificial Sequence
  Description of Artificial Sequence: Synthetic peptide
MASSTPSGATGSP

SEQ ID NO: 594 - protein, 13 aa, Artificial Sequence
  Description of Artificial Sequence: Synthetic peptide
MEASPGTSSTGSP

SEQ ID NO: 595 - protein, 11 aa, Artificial Sequence
  Description of Artificial Sequence: Synthetic peptide
MASTPESGSSG

SEQ ID NO: 596 - DNA, 51 bp, Artificial Sequence
  Description of Artificial Sequence: Synthetic oligonucleotide
atggctagtccggctggctctccgacctccactgaggaaggtacttctact

SEQ ID NO: 597 - DNA, 51 bp, Artificial Sequence
  Description of Artificial Sequence: Synthetic oligonucleotide
atggctagtcctgctggctctccaacctccactgaggaaggtacttctact

SEQ ID NO: 598 - DNA, 51 bp, Artificial Sequence
  Description of Artificial Sequence: Synthetic oligonucleotide
atggctagtccagcaggctctcctacctccaccgaggaaggtacttctact

SEQ ID NO: 599 - DNA, 51 bp, Artificial Sequence
  Description of Artificial Sequence: Synthetic oligonucleotide
atggctagtcctgctggctctccgacctctactgaggaaggtacttctact

SEQ ID NO: 600 - DNA, 51 bp, Artificial Sequence
  Description of Artificial Sequence: Synthetic oligonucleotide
atggctacatccgaaagcgcaacccctgagtccggtccaggtacttctact

SEQ ID NO: 601 - DNA, 51 bp, Artificial Sequence
  Description of Artificial Sequence: Synthetic oligonucleotide
atggctacatccgaaagcgcaacccctgaatctggtccaggtacttctact

SEQ ID NO: 602 - DNA, 51 bp, Artificial Sequence
  Description of Artificial Sequence: Synthetic oligonucleotide
atggctacgtctgaaagcgctactccggaatctggtccaggtacttctact

SEQ ID NO: 603 - DNA, 51 bp, Artificial Sequence
  Description of Artificial Sequence: Synthetic oligonucleotide
atggctacgtccgaaagcgctacccctgaatccggtccaggtacttctact

SEQ ID NO: 604 - DNA, 51 bp, Artificial Sequence
  Description of Artificial Sequence: Synthetic oligonucleotide
atggctagttctaccccgtctggtgcaaccggttccccaggtacttctact

SEQ ID NO: 605 - DNA, 51 bp, Artificial Sequence
  Description of Artificial Sequence: Synthetic oligonucleotide
atggctagctccactccgtctggtgctaccggttccccaggtacttctact

SEQ ID NO: 606 - DNA, 51 bp, Artificial Sequence
  Description of Artificial Sequence: Synthetic oligonucleotide
atggctagctctactccgtctggtgctactggttccccaggtacttctact

SEQ ID NO: 607 - DNA, 51 bp, Artificial Sequence
  Description of Artificial Sequence: Synthetic oligonucleotide
atggctagttctaccccttctggtgctactggttctccaggtacttctact

SEQ ID NO: 608 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 609 - DNA, 180 bp, Artificial Sequence; identical to SEQ ID NO: 608
  Description of Artificial Sequence: Synthetic polynucleotide

SEQ ID NO: 610 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 611 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 612 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 613 - DNA, 180 bp, Artificial Sequence; identical to SEQ ID NO: 611
  Description of Artificial Sequence: Synthetic polynucleotide

SEQ ID NO: 614 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 615 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 616 - DNA, 180 bp, Artificial Sequence; identical to SEQ ID NO: 614
  Description of Artificial Sequence: Synthetic polynucleotide

SEQ ID NO: 617 - DNA, 180 bp, Artificial Sequence; identical to SEQ ID NO: 615
  Description of Artificial Sequence: Synthetic polynucleotide

SEQ ID NO: 618 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 619 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 620 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 621 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 622 - protein, 288 aa, Artificial Sequence
  Description of Artificial Sequence: Synthetic polypeptide
GEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGE

SEQ ID NO: 623 - protein, 7 aa, Artificial Sequence
  Description of Artificial Sequence: Synthetic peptide
ENLYFQG

SEQ ID NO: 624 - protein, 12 aa, Artificial Sequence
  Description of Artificial Sequence: Synthetic peptide
GSTSESPSGTAP

SEQ ID NO: 625 - protein, 12 aa, Artificial Sequence
  Description of Artificial Sequence: Synthetic peptide
GTSTPESGSASP

SEQ ID NO: 626 - protein, 12 aa, Artificial Sequence
  Description of Artificial Sequence: Synthetic peptide
GTSPSGESSTAP

SEQ ID NO: 627 - protein, 12 aa, Artificial Sequence
  Description of Artificial Sequence: Synthetic peptide
GSTSSTAESPGP

SEQ ID NO: 628 - protein, 24 aa, Artificial Sequence
  Description of Artificial Sequence: Synthetic peptide
GSPAGSPTSTEEGTSESATPESGP

SEQ ID NO: 629 - protein, 36 aa, Artificial Sequence; identical to SEQ ID NO: 239
  Description of Artificial Sequence: Synthetic polypeptide

SEQ ID NO: 630 - protein, 48 aa, Artificial Sequence
  Description of Artificial Sequence: Synthetic polypeptide
GSPAGSPTSTEEGTSESATPESGPGTSTEPSEGSAPGSPAGSPTSTEE

SEQ ID NO: 631 - protein, 60 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAP

SEQ ID NO: 632 - protein, 108 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETP

SEQ ID NO: 633 - protein, 216 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP

SEQ ID NO: 634 - protein, 432 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAP

SEQ ID NO: 635 - protein, 864 aa, Artificial Sequence; identical to SEQ ID NO: 71
  Description of Artificial Sequence: Synthetic polypeptide

SEQ ID NO: 636 - protein, 576 aa, Artificial Sequence; identical to SEQ ID NO: 66
  Description of Artificial Sequence: Synthetic polypeptide

SEQ ID NO: 637 - protein, 576 aa, Artificial Sequence; identical to SEQ ID NO: 67
  Description of Artificial Sequence: Synthetic polypeptide

SEQ ID NO: 638 - protein, 540 aa, Artificial Sequence; identical to SEQ ID NO: 65
  Description of Artificial Sequence: Synthetic polypeptide

SEQ ID NO: 639 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 640 - protein, 864 aa, Artificial Sequence; identical to SEQ ID NO: 71
  Description of Artificial Sequence: Synthetic polypeptide

SEQ ID NO: 641 - protein, 875 aa, Artificial Sequence; identical to SEQ ID NO: 72
  Description of Artificial Sequence: Synthetic polypeptide
  MOD_RES (430)..(432): Any amino acid
  MOD_RES (443)..(446): Any amino acid

SEQ ID NO: 642 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 643 - protein, 875 aa, Artificial Sequence; identical to SEQ ID NO: 74
  Description of Artificial Sequence: Synthetic polypeptide

SEQ ID NO: 644 - protein, 1318 aa, Artificial Sequence; identical to SEQ ID NO: 77
  Description of Artificial Sequence: Synthetic polypeptide

SEQ ID NO: 645 - protein, 924 aa, Artificial Sequence; identical to SEQ ID NO: 76
  Description of Artificial Sequence: Synthetic polypeptide

SEQ ID NO: 646 - protein, 913 aa, Artificial Sequence; identical to SEQ ID NO: 75
  Description of Artificial Sequence: Synthetic polypeptide

SEQ ID NO: 647 - protein, 864 aa, Artificial Sequence; identical to SEQ ID NO: 78
  Description of Artificial Sequence: Synthetic polypeptide

SEQ ID NO: 648 - protein, 84 aa, Artificial Sequence
  Description of Artificial Sequence: Synthetic polypeptide
ASPAAPAPASPAAPAPSAPAAAPASPAPAAPSAPAPAAPSAASPAAPSAPPAAASPAAPSAPPAASAAAPAAASAAASAPSAAA

SEQ ID NO: 649 - protein, 4 aa, Artificial Sequence
  Description of Artificial Sequence: Synthetic peptide
GGSG

SEQ ID NO: 650 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 651 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 652 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 653 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 654 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 655 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 656 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 657 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 658 - protein, 576 aa, Artificial Sequence; identical to SEQ ID NO: 66
  Description of Artificial Sequence: Synthetic polypeptide

SEQ ID NO: 659 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 660 - protein, 540 aa, Artificial Sequence; identical to SEQ ID NO: 65
  Description of Artificial Sequence: Synthetic polypeptide

SEQ ID NO: 661 - protein, 504 aa, Artificial Sequence; identical to SEQ ID NO: 639
  Description of Artificial Sequence: Synthetic polypeptide

SEQ ID NO: 662 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 663 - protein, 875 aa, Artificial Sequence; identical to SEQ ID NO: 72
  Description of Artificial Sequence: Synthetic polypeptide
  MOD_RES (430)..(432): Any amino acid
  MOD_RES (443)..(446): Any amino acid

SEQ ID NO: 664 - protein, 868 aa, Artificial Sequence; identical to SEQ ID NO: 642
  Description of Artificial Sequence: Synthetic polypeptide

SEQ ID NO: 665 - protein, 875 aa, Artificial Sequence; identical to SEQ ID NO: 74
  Description of Artificial Sequence: Synthetic polypeptide

SEQ ID NO: 666 - protein, 1318 aa, Artificial Sequence; identical to SEQ ID NO: 77
  Description of Artificial Sequence: Synthetic polypeptide

SEQ ID NO: 667 - protein, 9 aa, Artificial Sequence
  Description of Artificial Sequence: Synthetic peptide
FDKLPRTSG

SEQ ID NO: 668 - protein, 7 aa, Artificial Sequence
  Description of Artificial Sequence: Synthetic peptide
FKLMVWY

SEQ ID NO: 669 - protein, 190 aa, Bos taurus; identical to SEQ ID NO: 22

SEQ ID NO: 670 - protein, 190 aa, Bos sp.
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 671 - protein, 190 aa, Bos sp.
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMREVEDGTPRAGQILKQTYDKFDTNMRSDDALLKNYGLLSCFRKDLHKTETYLRVMKCRRFGEASCAF

SEQ ID NO: 672 - protein, 190 aa, Gallus gallus
FPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 673 - protein, 190 aa, Meleagris gallopavo
FPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 674 - protein, 190 aa, Sus scrofa
FPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 675 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 676 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 677 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 678 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 679 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 680 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 681 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 682 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 683 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 684 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 685 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 686 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 687 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 688 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 689 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 690 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 691 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 692 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 693 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 694 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 695 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 696 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 697 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 698 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 699 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 700 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 701 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 702 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 703 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 704 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 705 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 706 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 707 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 708 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 709 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 710 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 711 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 712 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 713 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 714 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 715 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 716 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 717 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 718 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTI

SEQ ID NO: 719 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 720 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 721 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 722 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 723 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 724 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 725 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 726 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 727 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 728 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 729 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 730 - protein, 767 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 731 - protein, 767 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 732 - protein, 767 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 733 - protein, 816 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 734 - protein, 1027 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 735 - protein, 1055 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 736 - protein, 1066 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 737 - protein, 1055 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 738 - protein, 1066 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 739 - protein, 1104 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 740 - protein, 1115 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNI

SEQ ID NO: 741 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 742 - protein, 1260 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 743 - protein, 1393 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 744 - protein, 1404 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 745 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 746 - protein, 1260 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 747 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 748 - protein, 1393 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 749 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 750 - protein, 1393 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 751 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTIGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 752 - protein, 1393 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTIGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 753 - protein, 1249 aa, Artificial Sequence; identical to SEQ ID NO: 741
  Description of Artificial Sequence: Synthetic polypeptide

SEQ ID NO: 754 - protein, 1393 aa, Artificial Sequence; identical to SEQ ID NO: 743
  Description of Artificial Sequence: Synthetic polypeptide

SEQ ID NO: 755 - protein, 1249 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNIGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 756 - protein, 1393 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNIGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 757 - protein, 1260 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 758 - protein, 1260 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 759 - protein, 1260 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 760 - protein, 1260 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 761 - protein, 1404 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 762 - protein, 1404 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 763 - protein, 1404 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 764 - protein, 1404 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 765 - protein, 1271 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 766 - protein, 1271 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTQSLVFGTSDRVYEKLKDLEEGILALMRELEDGTPRAGQILKQTYDKFDTNMRSDDALLKNYGLLSCFRKDLHKTETYLRVMKCRRFGEASCAFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 767 - protein, 1271 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAFGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 768 - protein, 1271 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAFGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 769 - protein, 1415 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAFGLTPRSLLVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 770 - protein, 1415 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAFGGGKLTRVVGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 771 - protein, 1415 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTIGGGLGPVSGVPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 772 - protein, 1415 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPAMPLSNLFANAVLRAQHLHLLAAETYKEFERTYIPEDQRYTNKNSQAAFCYSETIPAPTGKDDAQQKSDMELLRFSLVLIQSWLTPVQYLSKVFTNNLVFGTSDRVFEKLKDLEEGIQALMRELEDRSPRGPQLLRPTYDKFDIHLRNEDALLKNYGLLSCFKKDLHKVETYLKVMKCRRFGESNCTIGAPLGLRLRGGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 773 - protein, 972 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGLTPRSLLVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 774 - protein, 972 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAFGGGKLTRVVGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 775 - protein, 972 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNIGGGLGPVSGVPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 776 - protein, 972 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFPTMPLSNLFTNAVLRAQHLHLLAAETYKEFERTYIPEDQRYTNKNSQAAFCYSETIPAPTGKDDAQQKSDMELLRFSLVLIQSWLTPMQYLSKVFTNNLVFGTSDRVFEKLKDLEEGIQALMRELEDRSPRGPQLLRPTYDRFDIHLRSEDALLKNYGLLSCFKKDLHKVETYLKVMKCRRFGESNCNIGAPLGLRLRGGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 777 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 778 - protein, 13 aa, Artificial Sequence
  Description of Artificial Sequence: Synthetic peptide
  MOD_RES (3)..(4): Ala, Pro, Ser, Thr, Gly or Glu
  see specification as filed for detailed description of substitutions and preferred embodiments
MAXXAGSPTSTEE

SEQ ID NO: 779 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 780 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 781 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 782 - protein, 13 aa, Artificial Sequence
  Description of Artificial Sequence: Synthetic peptide
  MOD_RES (3)..(4): Ala, Pro, Ser, Thr, Gly or Glu
  see specification as filed for detailed description of substitutions and preferred embodiments
MAXXTPSGATGSP

What is claimed is:

1. An isolated fusion protein, comprising an amino acid sequence which is at least 95% identical to SEQ ID NO: 289 or 741, wherein the fusion protein comprises a growth hormone (GH) sequence that is at least 95% identical compared to an amino acid sequence selected from SEQ ID NO: 669 and SEQ ID NO: 2.

2. The isolated fusion protein of claim 1, comprising a growth hormone sequence which is a bovine growth hormone sequence.

3. The isolated fusion protein of claim 2, wherein the bovine growth hormone sequence is at least 95% identical to the amino acid sequence of SEQ ID NO: 669.

4. The isolated fusion protein of claim 3, wherein the bovine growth hormone sequence has the amino acid sequence of SEQ ID NO: 669.

5. The isolated fusion protein of claim 1, comprising a first extended recombinant polypeptide (XTEN) which is at least 95% identical to the amino acid sequence of SEQ ID NO:75.

6. The isolated fusion protein of claim 1, wherein the growth hormone sequence is linked to an extended recombinant polypeptide (XTEN) via a spacer sequence, wherein the spacer sequence comprises between 1 to about 50 amino acid residues, and wherein the spacer sequence optionally comprises a cleavage sequence, and wherein the XTEN is at least 95% identical to an amino acid sequence chosen from SEQ ID NOS: 61 and 75.

7. The isolated fusion protein of claim 1, wherein the fusion protein binds to the same target receptor of a corresponding native growth hormone that lacks the extended recombinant polypeptide (XTEN), and wherein said fusion protein retains at least about 0.1%-30% of the binding affinity of the corresponding growth hormone not linked to the XTEN.

8. A pharmaceutical composition comprising the isolated fusion protein of claim 1, and a pharmaceutically acceptable carrier.

9. An isolated nucleic acid comprising a nucleotide sequence encoding the fusion protein of claim 1 or the complement thereof.

10. The isolated nucleic acid of claim 9, wherein the polynucleotide molecule encoding the fusion protein comprises a nucleic acid sequence exhibiting at least 90% sequence identity compared to a nucleic acid sequence selected from SEQ ID NOs: 107-123.

11. An expression vector comprising the nucleic acid of claim 9.

12. An isolated host cell comprising the nucleic acid of claim 9, wherein the host cell is a eukaryotic host cell.

13. An isolated host cell comprising the nucleic acid of claim 9, wherein the host cell is a prokaryotic host cell.

14. The isolated host cell of claim 13, wherein the host cell is *E. coli*.

15. The isolated fusion protein of claim 1, wherein the growth hormone is a porcine growth hormone.

16. The isolated fusion protein of claim 15, wherein the porcine growth hormone sequence is at least 95% identical to the amino acid sequence of SEQ ID NO: 2.

17. The isolated fusion protein of claim 16, wherein the porcine growth hormone sequence has the amino acid sequence of SEQ ID NO: 2.

18. A method of enhancing a growth-hormone related parameter in an animal, comprising administering to the animal a physiologically effective amount of an isolated fusion protein, comprising an amino acid sequence which is at least 95% identical to SEQ ID NO: 741, wherein the fusion protein comprises a growth hormone (GH) sequence that is at least 95% identical compared to an amino acid sequence selected from SEQ ID NO: 669 and SEQ ID NO: 2.

19. The method of claim 18, wherein the growth-hormone related parameter is selected from IGF-1 levels, IGFBP3 levels, growth velocity, total body fat, muscle mass, bone growth, lactation, duration of lactation, hoof growth, lipolysis, efficiency of converting feed to meat or milk, and multiplication rate of chondrocytes.

20. The method of claim 18, wherein the isolated fusion protein comprises at least one extended recombinant polypeptide (XTEN) sequence which is at least 95% identical to an amino acid sequence selected from SEQ ID NOS: 61 and 75.

21. The method of claim 18, wherein the growth hormone sequence is a bovine growth hormone sequence.

22. The method of claim 21, wherein the bovine growth hormone sequence is at least 95% identical to the amino acid sequence of SEQ ID NO: 669.

23. The method of claim 22, wherein the bovine growth hormone sequence has the amino acid sequence of SEQ ID NO: 669.

24. The method of claim 18, wherein the growth hormone sequence is a porcine growth hormone sequence.

25. The method of claim 24, wherein the porcine growth hormone sequence is at least 95% identical to the amino acid sequence of SEQ ID NO: 2.

26. The isolated fusion protein of claim 25, wherein the porcine growth hormone sequence has the amino acid sequence of SEQ ID NO: 2.

* * * * *

UNITED STATES PATENT AND TRADEMARK OFFICE
CERTIFICATE OF CORRECTION

PATENT NO. : 8,680,050 B2  
APPLICATION NO. : 12/848984  
DATED : March 25, 2014  
INVENTOR(S) : Schellenberger et al.

Page 1 of 1

It is certified that error appears in the above-identified patent and that said Letters Patent is hereby corrected as shown below:

Title Page, Item (75) Inventor is corrected to read:
-- Volker Schellenberger, Palo Alto (CA);
Joshua Silverman, Sunnyvale (CA);
Willem P. Stemmer, Los Gatos (CA);
Chia-Wei Wang, Milpitas (CA);
Nathan Geething, Santa Clara (CA);
Jeffrey L. Cleland, San Carlos (CA);
Benjamin Spink, San Carlos (CA) --.

Signed and Sealed this
Fifteenth Day of September, 2015

Michelle K. Lee
*Director of the United States Patent and Trademark Office*